United States Patent 12,576,115 (BACTERIAL COMPOSITIONS FOR TREATING AND PREVENTING HALITOSIS) - sequence listing, part 15

SEQ ID NO: 27 - DNA, 3704609 bp, Bacillus pumilus (residues 1,852,306-3,704,609 of 3,704,609)
  source 1..3704609: mol_type = genomic DNA
tataccgtaataatgagggagacttgaaaggaagtaatggaaagtgtcttttctatctgtggcaatacgggaatgagcatcgagttcccaagtgtcatgattaaaggcactgatgataatgcaataatattctttttactaactgttttctcgcccaacatcattcacccaattctatatactgttacgtattagtgtggcaagttttacgggtattatgtatgggcaaacaaaaagcaaccgcttatgaaagcgactgctcgttaaaatcgtttacgtatcacatgaaagctgaatttatccgctcgaaaataatttagtgagtataagaccggctgatcatcctgatcatagtgcatttgtttcaataataataatgctgtttcaggatcacattctagtatcggtgaaacctgatcgtggtagccgattggttcaatgtcagcaactgcatatttaatcccgctgtgtggttctcttccaaacagctcaaaaagagactcttcttcatgtgtaaaagaagcaggaagatgcttaaccggaattttatctaaacagtaaaccactggctgtccatctgccgttcgaacgcgctccattgaaaaaatctcatcagattcatcacactgaaaacgaatcacatcattctctgttggctccccttcttgggaggataaaaagatggtaccaggcgtcatattgacctgctctatcattttcgtgacacttgccagctgttctatgcctgttgaaaagagtggtcttgtgttgacgaacgtacccacaccatgccttctaattaaatatttctcttcttctaatatacgaagggcttcacgcagtgtcgctctgctcacgcctaaaagctttgagagctcaaattcagaaggcagtttctctttttcggcatatacgcctgtttgtatatcttctttaatacggtcaatcactttcaaatataaatggcgattgtctgttttggtcgacatgttttccctccgtctaatcaatgcaaatgataagatgagaaatctctattccgagataagttgaacataactatatcatgtttttgcaaataaataaatagtctgacttccagttaacataatcatactatcgttcacttcttttttagaaagctctcttcgatttatgaagagagctcgtcatattgttcttttgaaagcaggacttctctcggtttacttccttcataaggaccaacaacgccccgctcttccattgcgtcaatcaggcgagcggcccgggtatagccgatacggaatcttctttgaagcatagagacagaagccgtctgcatgccgatgatgagttccactgcttcatcatataaatcgtcatccacagatgtaagctgttcctgcgtttcttcagttggaatcatttcttcttgatattgcgctttttgctgagtgatcacatgatcaacgacatgctccacttcttcatctgataaaaaggcgccctgcacacgaacaggtttgtttgcaccaactggcagaaacagcatgtcccctctgccgagcagtttttctgcgccccccatatcaaggatcgtccttgaatcagtttgtgaggacacgctaaaggcgatgcgagatgggatgttggctttaatgacacctgtaatgacatcgacagaaggtctttgtgtggcgataattaaatgaatcccagctgcacgagccatttgcgaaagtcttgtaatggaatcctccacatctgaggaagcgaccatcattaaatctgcaagctcgtctacaatgacgacaatataaggaagttctggctgtttcgcctcttctgattgattcattcttttaatgtaatcattgtatccttcaatgtttcttgtccccgtatgagaaaataattcatatcggcgttccatttcactgacgacttttttcagtgcctgtgaggcttttttagggtccgttacaacgggagcgagcagatgcggaatgccattatacacatttagttcaaccattttcggatcaatcatcatcatttttacttcatgaggtttcgctctcatgagaatactcgtgataatgccattaatgcacacactttttccgcttcctgtcgatcctgctacaagtaaatgcggcattttgttcatttcagcgagcacggcttcacccgaaatattgcggccgagtccaatcagcagcttcgcatttggacggtcattttgcttcgattctaatacctcttttaaagaaaccatcgcaatttctgcattaggaacctcaatcccaatggctgatttcccaggaatcggcgcctcaatccgaatatcttttgctgcaagagcaagggctaagtcatcacttaaattgacgattttacttaccttcacgccaacatcgggatagacttcatatttggtgacggctggtcctaagtgaacctgtgtgacttttgcttttacgccgaagctttgaaacgttttttcaagctttcttgcattttcatatatattcttcttgtctgtttgctgtcctgagtgctgcggctctgccaaaatatccagtgacggcaattcgtaatctttgttttcaagttccgtaaacgtcatcggcggcgcctcttttggttcatcagctgaatctgatggagcaggcgcactttgcacagattcttgaagaggcgaagtctcttttgccgcctgctctttttgaacgagcggggtgagaatgtcatctctatctgcaaagcttgagataatcggctgactattgtcaggcaccgctgcttcctcttcaactaaaatctgatcatcttcgtcctcttcctgaatacgagaccgttttttcttttcggccgttttctgagagggcacgctctttttcgcctgccggattcctttcatatcttcaacaaacgctttccattgcttcaccataaattgcgagacaggcagcgtcacttttttcaccatttcttgaagagatcgatttgtaatcagcacaattccaatcagcatcagaacgattgccatgatttgagagcctgcttgtgcaaataagaaataagaagcagcaaataatacggcaccgatcatgccgcctcctaaatcaggcgaccccgtctcacctttcatgtccatcaagaaaagctcaaatgtatttctgatcacactttgagagcctaccgcacctgcagatgagaggtgctgaaagagcttcacatgagacaaaagcaagatactcgcaatgatgcagtatagccctgcctttctccttgtcaacatatctggaatttgttttttccagaagatggtcacgccaaaaagaaataatccgataaggcagagaatgaaccattcgcctgcaaaaaatcggaataaatatacgaaggtttgtccaacgacgcctagctgtaaaatggcaatgatcgctatggcaatacagactaacccatttaattcatatttcagttttagctgtttattttgtttttttctcgttttccgttttctttttttagccatactcatcaccttactacgaaagaaaatataacctaccgaaagatcagaaagaaagcagcctggttttggctgcatcttgttgtaagttttccctttattatagcatagaatcattcatatgagtcggtttgattggagcctaattgtaacttcaatcgcttgcctggtgcaagctcttgattcagaaaatccattggattggtactcatgacttgaacgatttctgcttcatcctctttcatttcaaccataactggcacgccttggatggttacctgctgaagtttgcggtctccttgctcctccgcgtaaatggcttcatatggcataggtgtgtataaaatcattggatcatcccctcgttttgagatgccctttctccaatcagctcattcaactttttaatcgcttgtcctacaccgcctacttcattcatgagtccgtatgctgctgcctcatgaccaacaacatttgttccaatgtctcttgtcaaattgccttttgagaacatgagctctttgaacttctcttctgtaatattggagtggcttgtcacaaagttaatgactctttcctgcattttatctaagtattcaaatgtttgcgggacaccaatgacaagaccagttaagcgcacaggatgaatggtcatcgtggctgtttccgcaatataggaatagtcacacgatacagcaatcgggacaccaatggagtggccgccgccaagtacaatcgatacagtcggttttgatagagacgcaagcatttctgcaatcgctagccccgcttcaacatcgccgcctactgtatttaagatgatcaaaagaccttcaatttttgggttttgctctactgctacgatttgcggaatgacatgttcgtatttggtggttttattttgtggtggaagctgcatgtggccttcaatttgtccaataatggtaaggcaatggatatttgtatcttgcggcagctgtggtatagctgtttcaccaagctgctgtattttgctcattatgctgtctttttcttctggctttcgctcaggctgctgttcatttttttcgtccatttgtctccatcctttcctcaaactctcctcctattatgaacaagaaggccgtattcaatccgtattcctcgcacgacatcaaaaaagcccaaagagcttatgctccttgggctttctcatcacacttccataataattggaatgatcatcggcttacgttttgttttttcatataggaattgattaagtacgtcacgcatggattgtttcaatgttgaccattcaacaattgagttttccgtttgctctttgacaattcctttgaccatttctgtcgctttcacaatcagctcttcagactctctgacatacacaaatcctcttgtgatgatttcaggtccagaaattaattgtttcttttgtttatcgagcgtaatgacgacaattaagataccgtcttgagacaataaacgtctatcgcgtaacacaatgttaccaatatcaccaacgcccagaccatcgatcaaaatattgccttggtgaactttttcaccgatcttgacgttctgtcctctaaactccacaacatctcctttatcaatcaagaaaatgtcacttcgtttcattcccacttcttcagcaatacgagaatgtgctttttgcatacgatattcgccattcaccggaattaaatacttcggcttgagtaagttcagcatgagctttaactcttcttggcagccgtgtccagagacatgtacacgtttttgcgcaaaaatgacttgtgcgccgcttcttgtaaggaaatcaactgtttttgaataggtgagttcttgtccaggaagaggtgtagatgcaatcacaaccgtgtcatctttttcaatatgaagctgtttgtgattttgtttcgccatttttgttaacgcagcaagaggctctccgtggcttccagctgtcaggatgaccacatcgtttttcgccattttcttcacttcttgaactggtacaaataattcttcgtctgctgtgacataaccaagtttgatcgccagctgaagagtcgtcatcatattctttcctgctacggcaagcttacggccattttgatttgttgcattaatgatctgctgcactcggttaatgttagatgaagatacagccacaatgacacgattttcagtattgtacatcgcatttgagatttcgtcttggacgagcgcctcagaaggtgtataacctggtttttcagcattggcactgtctgaaagaagtgctaaaacgccattgtttcctattttcgcaatctctcctatgtcacaggcttggttaagcgctggggtttgatcaaatttaaaatcacctgtgcatacgattgaaccaagagaggttttgaagctgatcccaactgaatcagggatgctgtgattcgttctaaagaatgatacctttgttgtttcaaacgtaatgactgattttgcatgtacctcacgcaagtcagctttttgattgaagccatactgttttaatttttctcgaagtaacgcaagggtcagcttcgttccgtaaactggtacagacaatttgcttaagcaatggaatacgcctccgattgcttcatcatgtccgtgggtaagaaaaattgctttcacccgatcagcacgttctgttaaataagagatatcaggaatgacgacgtcaatgcctagcatttcgttttccggatgcatcaagcctgcatccaccacatatatgtcggaatcaatttcaatgacatataagtttttcccgatttctccaacgcctccaagtgcaataattcttacgttctctgtatttttctttttcaaaattcttatcctcctagtctcaagcccgtccatcatcgcttaatgctattataactgaatctaattttagaaaacaagatgaagtcacattttaagaaagtgtttatgtataaaaaacggtcatactcagggacatctgagaatgaccgcttacgaaatcttttgttttgatcagctgtttaaaacgctgcttaaatccagtctctcttcttctgacaaaggtagaagcggaagtcgaaccgatccgacatctagtccttttagctgaagagctgttttaacaggcgttggatttggcgctgagaatagctgtttcatgattgggagcagcttttgatggatcaaagcggcattggccgtttgacctgaagcatagcttttcagcatttcctgcatatcaagccctacgatatgagacgcaacagagactactccttttgcaccaacagatacagcaggaagtgttaagctgtcgtcacctgaataaacatcgaaatcttctggtgtctctgcaatgatttttgtcatagcatcaagatcaccacttgcttctttgatagcgacgatgttaggtatttgcgcaagcttaatggttgtttctggggctaatgacgcaaccgttctccctggtacattgtaaagcatgacaggaagagatgtagactcggcaatggctttaaagtgtgcatacatgccttcctgtgatggcttgttgtagtaaggtacgacaagcatcactgcatcaacgcccgcttcttctgcttttttcgttagtttgatagacgcatttgtattattactgcctgttcctgcaatgattttacaacgaccatttgctaattttaccgattgctgaaaaagagcgactttttcttcagtcgataaagttggcgattcgcctgttgtccctgcaacgactaacgagtcactgccgttttttaacaagtaatcaatgagaattgatagcttttggaaatcaatgttgccctttttatcaaaaggtgtaatcatagctgttgcgatatttccgaaattcatttttttcacctcatcatgattcaatcacatttatcttgaaagttcaaacacttcgtgcagggcattgacagccgctctcatgttttcttcgttcactagcacccaaatggtcgtatggctgtcagccgattgtaaaatcggaatgttttgctcggatagagccgatacaattttagatgtgacacctggtacacccatgatgcctgcgccaacagctgatactttcgcacaatttgttgtgacaattggcgtatagccaagatcttttaggatcgaggttgccttttcagtcattgtacctgtcacggtatacacaatctcactcggcgtaatgttgaagaaatcgacactgatttgtgcattagccattgctttaaagacctctgtttggacgctgtactgcccttcttttgctgggactttgatttgcgtcacatcattgacatgtgcaatacccgtaatgaggcggtcatacacatcatggctcattttatctgagtagtgtgatgtgacgagtgtgccctcttcatcagagtatgttgaacggaccctcattggtacttttgcttgcatcgcaatttcgacagctctcgggtgaatgacttttgctccttgatatgcaaggttgcaaatttctgtataagtcacgactctgagcggctttgcattttcaacaatgcggggatctgccgtcatcacgccttctacatctgtaaaaatatcaataaagtctgcctgcaatgcagcacctaaagcagctgcggacgtatcactgccgcctcgtccgattgtggtcacgtccccatttttcgcagctccttggaacccagcaacaacgacaacatcatgttcagacagtgccgcctcgagacgctcacacttcatatcaataattttcgcactcgtatgctccttatctgtcacaaagccagcctgtgcgcctgtcatcgctacagcttttagcccgttttcattcagcatacttgaaaacacaacagctgaaatattctctccgcaggaaacgagcaagtctttttctcgatttgtcatgtgctgcgcgctgccataaagcagaccaagcagcgtatctgtcgcataaggatcaccttttcgtcccattgcggaaacgacgacaaccgacttatagcctttctcttttgccgataagatatgtgcaagtgccctttttctaccttgatcatctttgacagatgtaccgccaaatttttggacaattattttcactgtcttcactccaagttcattctgacgtaacagaagagagcaggcgaaagatgcctaactctcttctgttcgtcctcatcatccattgaatgttaaactaattttaatgcttttaagctttctgcaatttgaacggagttccatgcagcgccttttagcaggttatcagatacaatccacatatggaacccgtttggacggtccaaatctttccgaatgcggccgacaaatacgtcgtttttcccaacagcatctgcaggcattggataaatttgctgagacggatcatcttgcaatgtaatgcctggagcatcttttagaacggacttgatgtcgtcaactgttgcgtcgtttgattctagttcgacgtaaacagattctgaatgtcctgtttcaattggaagtctcacacatgttgccgctacttccagctctggcatatgcatgatttttttcgtttcgttgatcattttcatttcttcaaatgtataaccattgtcttggaatttatcaatttgcggaatcgcattaaatgcaatttgataaggcatgacttccggcttcacatcttctttatttaaaatggcttgtgattggctgtatagctcgtcaatggcttcatgtcctgcacctgatacggcttggtaagtggacacgatgacttttttcatgccatacgcctgacgaagcggttctaatgccgctaccatttgaatcgttgaacagttagggtttgcaatgattccttgatggtcatgcaagtctttttcgtttacctctggtacgacaagagggatgttttcgtccatacggaaagcacttgtgttgtctacaacaatcgcacctcgtttgaccgcttcaggagctagcgccttggaaacatttcctccagcactgaataatgcaatgtttactccttcaaagctttcaggtgttgcttcctgtacgatatactcttgacctctgaatgtcacttttgttccagcagaacgttttgaggatagtagagtcagtgtatccatttcaaaatctctgtcagctagtgtttttaacatttgttgaccgacagctccagtcgctccaactacagctacatgcaatcctcttcccatcagtaaaactccttccgacccatccatgattcttttctttcggatggccatcctatgactttttacattttattttaccatagaaaagcaaggcttgaagcatcttttttgaatctttcatgattttctagtaaatctattattcgtttggtccaattaaaatcggctgaatttgtctatgctgaagtgcctcttccactgtttgagaaagcagattcatgttcgcgaccatggaggtcggttttttaaatggatcatcttgaccaaatggaataaagaaaatattctttgtcgacatcaacctcatcagatttgtaccatttaagcctagcgcatcatttgttgaaattcctaaaacgacaggacgatgatttcgaatggttgcttttgcagccattaaaacagggctgtctgtcatggcatttgcgaatttcgccatcgagttcccagttaatggagcaatgaccatacaatcaagtggcagcttaggcccgagcggctctgctttcacaattgagtcaattgccttaaagccagtcagcttctcaatccgctcaatccagtccgccccatctccgaatcttgtattcgtgttctggaccgtatatgacaccactggacgcacttctgctccttcttttacaagtgcttcgatttgcggataaaccgcttcgtacgtacagtgggaaccagttaagccaaagccgattcttttcccttttaatgttgtcatgattccatcccccttttttcctctgcaagttcacataagagcccagaaagcacttttgcaatgatttgccctgctgtctttggcgcaacaattcccggaagtccaggtgcaagaagcgccttcactccgtgtttttgtgcaaagtcaaagtctgttcctcctgggcgggaggcaatatccaaaatgagtgtctttggtgtcatattgacgatgacagatgaatctaatacaaggcttggaatggtattgatgaggatatctacatccgttacttcttcttttaactggtccattgaaaatggatcgagtcccatttcaaaggaccgcgccaagtgagctgtatctgctgcccctacttttacgtccgcaccgagtgcccgaaatgtgcgggcaatggtgagtcctgttcttccgagcccgagaacagcaacacgtgatccatgaatcgtataatccgtttgctgaatggccatcatgataatcccttcaactgtaggaatagagttatatatggcaatatcatctcgctcaaacagcttcacaagttttcggttcacctgctttgccagattgtctaagtacgtattagaaatacctgagtacaaggtacaatgggcaggggttctttctaaatatgttgcttctagtaaaacctgctcatttgagaaaactgtcgcgacaacaccttcatccgttgcgcctgatactggcaggatcatactgtctacctgttcgaatggtagttctgacatttttagcttttcagccccaataaatccgtgatccagctgatcaaatccaaccaaaaacactttggcatgctgctgtgacagcttgcgaataatttcaagctgccttgcatctcccccgatcaccgcaaccgttaaaccgctcaacatactgaccgttcaccttctttatttaaaaaagtctgtaatattttctgaatctccctttcagcatatgaggagaggattcagcctgtgaacaaatcgaagagagaaaagaaaaagagcacccatttatgatggatgctctttttccccgggcggctgaagtgcttcaggcacatcgagaatgatcatatctgatcctattttttgaatgtgattccaggggacgcggatgtcatttccttgctttcgaaagccaaaccacttcaccgaaggtatgataagtgctgtgatttgaccgtcttgttcattgatttcaaggtcggtttgtccaagcacaccaagccgctccgctcttttgatatcgacaatctcttttcctgacagctcacttaacctcaaaatcgcatcacttcccttccgtatcatatatgcagccacaagaagaaatagaccgtcccgctttttcaagttatgaatgatgccaatttgaataccaagctggtttcagtagatgaaagtgatcatggtctgccagcattctctccactcggttcaccatatcttttacatgttcagtgtcataagaaagcgtccagacaatagaagaaaagcagctcattgctgtatagatagaaaaaagaagccaaaaatcgtctgtggcctgcgtacttacatagtaatccagttgcccagctgaaaacggaatactattttctcggctaaataaggacaatttataaaaatcatgaactgggtcaccccagtcagattgatcaaaatcaatgactcctgaatactcaccttcttgtatgatgatattccccaaatgaaaatcatcatgctggaattgattaggcctcgcctttactgcatcaacatgtgatttaataaaatctaatacgaaatgatcctgatcgaaggtcactccacttgattgataggcatgtacataccgttcatgtttcatcatgaccctctcatcccatgtcgcgatatgagaaggtgcgggacatgtgtgcatgaaactaagttctttgcctgcccgtctcccgatttcatactgctcttcatttgtaagcagatggatgaatgctctagcattctctccttcaataaaagagaaaatacgataggtacagttgagttcagtattcatcccaatctccatcacttcagaacatagaaggcctcgatctttaaacttttgctgaactgacgcttttcttttaaaattggaatacgttttgaggtttgatagcttgagcactagcttttcacttgaggatgttgtgacgagataagtacggtttccagaaaggccagatgtcattggctcaaaggaggtggcttgtgtcagaagcggagaaaggattttcagtttttcacgttccatgtaagcagcgcccctttcttcttgatatataataaacggcagacctcttaagaagcctgccgtgttgtttacattatgatggctgatcacccgtaggactaataagcgagagcgcataatcctctgtaaagattcgtttggataagttattcacaccttctaatgtgactttgttgatttcgtcaataatttcatcaagtgtgcgatgtttgccaaggagcagttcgtttttaccgtttcggctcatcttgctgtttgtgctttcaaggctgagcatcaggttccctttcatttgctccttagagttttcaagctctttttgcgtgattccctcacgctttaagacgtctagcgtttgtaagatggtttcagagagcaggtttaactgcttcgctccagtcccgccataaatcgtcagcatgccgttatctgcaaatgaactgtgatagctgaaaacagaataagcgagtcctttgtcttctcttacatcctggaacaagcggctgctcatgcttccgccaagaacattatttaagacgattaagtcatagatgcctttgtctccagctgggaggccattaaagcccaagcatagatgcgcttgctctgtttcctttttgcgtgtgagcttgtcatagtgaaattgcggcgcttctacaggctgtttttttcctttcgtttcatacgaaccgaacaacttttcaacttcactaatgaatgtgtcatccacattccctgcaacagagatgacgacgcggtccggcgtgtagaattcatccatataagctctaagagagtcaccgttaaaggtagaaagtgtttcttctgttcctaaaatcgggaagcctaaagaatgatcaccataaatcgctttgctcaacagatcatgaacgatatcatcaggtgtatcctcatacattttgatttcttcatatactacatttttttcttttttcaactcttcttcatcaaaagcagagtggaagaacatgtcgcttaatacatcgagggcgtagccagcatgtgaatcaagcacctttgcatagtagcaagtgtattcttttgacgtaaaggcattcacttgaccaccaatgcggtcaaaggattctgcgatatcacgtgcagatctcgtctttgttcctttaaagaacatatgctctagaaagtgtgagatcccgttaatttctggtgtctcatgtctagaaccagttccaatccagacgccaattgcgacagatcttacagtgggattgttttcaagtacaattcttactccgttttggcatgtatacgttttgaccaagttttgctcctcctattcaacaaacagatcggatcacggatgtcttttttcacttaggaggtcagaaaccgttcctaattcatatcctctttccttgatttgagtgataagtgcgtcaagacttttcgccgtcgaatctgttggatgcattaatatcatcgccccattgtgaattttcccaagcacccgtttttgtagtatatttggtgacggtttttgccagtcaatggtgtctaccgtccacataatggtttccattccttcttctgcagccagcttcactgtttcttctttgaaactgccgcttggaggggcgaaccatttcggtttttttccaagggattcttcaatttgacgattcgttttggtaatctgctctaatgctcgttctcttgtcagtgtgcgcatatcggggtgattgtatgaatggtttccaatttcatgaccatctgccacgatctttttagcaagatccgtgctttttttcacccatttgccttctaagaaaaaggtcgccttgacctgatgcttttccagtgtctttaacatcttgattaaatgctcgtcaccccaagccacgttgatgaggaaagcattcatttttttatctggatgtcctttgtaaatgggttcagcactaagttcatgtaaatgaatagtaggttttgtttcattgaaaacaagcagcttttcatcaaatgaccctcgttttttcattttttcataagaggcatcgatattgaccgtctgtccatttagaccaggcatctttttccacactttatcaatcttagcattttgcgccttcacttcatagtcagaagacttcgattcaatctcttgatataaaatatcttttgaaacagatgcaacctcagcatgctctttcattgattcaatatatgtaacagcagccggctgcttcatcgtttgatatgacacgagcagtaaaaatacaaacacaatgaacggtaacgtttttttcaatggttgtccctcccctttaccacaaattatgatagggagaaacaagctagaactattgttagcacaagaaaagaaagaagcctggtacggatacctggcttctaacatatttcattaagactgtttttcttctttttccttttcttcacgtaaaacagctttgcgagaaaggttcacacggccctgtttatcgatttcagtgactttgacaagtaattcatcgccaattttcacgacatcttctactttgcctacacgatcaagcgcaagctcagaaatatgaacaagtccatctttgccgctgaagatttcaaggaaagcaccgaatttttcaatgcgttttactttacctaagtaaagttgtcctacttcaacttctctcacaagatcttcaatgattttcttcgctttttggttcatatcttcttcagtagaagagataaagattgtaccatcttgttcaatatcgattttcacaccggtatcttcaatgattttgttaatttgtttaccgcttggtccaatgacatcgcgaattttatcaggattgattttcatcgttaagatttttggtgcataacgagacaattctcctctagaagcaggaatcgttgacagcatgctatctaagatttccattcttccttttttcgcttgttggagagcttcttccaaaatgtcttttgaaagaccatcgattttgatatccatttgaagtgctgttacaccttttgatgtacctgcaactttaaagtccatatctccaagtgcatcttccattccttgaatgtctgtcagcactgtgtagtattccccagatttcacaagtcccattgcaatgcctgcaactggtgctttaattggaacacccgcatccatcatcgcaagtgtgcttgcgcaaatacttgcttgtgaagtagaaccgtttgattctagtacctcagacacaaggcgaaccgtataagggaaatctttttcagatgggatcactggttctaatgcccgttcacctagtgctccatgtccgatttcacggcggcctgggccacgcattggacctgtctcaccaacactgaattgcgggaagttgtaatggtgcatgaagcgttttgattcttcaacgcctagaccgtcaagaatttgcacatcgccaagtgcacctaatgtacaaatactgagcgcctgtgtttgtcctcttgtaaatagacctgaaccgtgcgttcttggcagaagtcctacttctgaagaaagtggtcggatttgatctacaccgcgtccatctggacgtactttctcttcagtgatcagacgacgaacttcatttttgacaagcttgtttaatacgtctttcgcttgtttaattgtcgcttcgtcgcgatcttcttcttcaaatttctcaaccacagcttttttcacagcactgattgcatcttcacgtgcatgcttctcatgtacttgaatcgctttcagcaggtctgtttcagcaagtgcctttacttcgtctgctaacgtttgatctacttcatataaaggaatatcgatctttgctttaccgactgccttgacaatttcctcttggaattcgattaaacgtttgatctcttggtggccatacatgatagcttcaagcattgtttcttctggcacttcatcagcaccagcttcgaccatgttgatcgcatcttttgttccagcgactacaaggttgatgtcactttgttcaagctgttctacattgggattgatgataaactttccatcaactcgtcctactgtaacgccggcgattggtccctcaaatggaatgtcagacacacataatgctaatgatgagccaaacattgcagccatttcagatgaacaatcttgatccacactcatgacgatactaatcacttgtacttcgtttctaaatccatctgcaaataatggacggattggtctatcaattaagcggctcgcaaggatcgctttttcacttggacggccttctcttttaatgaagccaccaggaattttacctactgcgtacaatctttcttcgtagttcacagtgagcgggaagaaatcaagtggttttggttctttagaagctgttgctgagctaagcacagctgtatctccgtagcgtacgaggaccgctccgtttgcttgctttgcaagctggccagtttcaactgtcagttgacgtccagcccagtctatggtgaagacatgtttctcttgtcccattctgagaaaaactcctctcttatcttgaaattttagttaattcttattatgaacaaaatgattttcacatatcaatgtgaaaggtgtatgtagaagggtttttgccattctttcaacattttaaccataaaatattagtgattatacgataaaaaagcgggaatcctcccgctttttacgattatcgacgtaagcctagtttgttaattaactcacggtaacgagttacgtctttattacgtagatacgtaagaagattacgacgtctacctaccattttcaaaagaccgcgacgtgagtggtgatctttcttatgagtacgtaaatgctcgttcaagttgttaattgattctgttaggacagcgatctgaacttctggagatccagtatcagattcgtgtgttttgaactcactaattaattgagttttacgctcttgagtaatagccatcctgtttcacctccaaatcatgttagccccatctacctcgcaaccgtcggtgaagtcggcctgccaagtaagtggttttaaagctacaggaataatcatactaaaaatacgctgaatttgcaaatggtagagctgtttttctatgaattttttgtttgctttcgctgatgttgaaaaaactgaatcgcttcttctttatcttgactgatttgtgccgttaactcctggattccgttaaatttttgctcactgcgaatgcgcttgaaccactgtaatttaatcggttcaccatatatttcttcgttaaaatcaaagaggtttacttcaatagcaggctgatcagggcgtttttcataaaaggttggtttatagccaatgttacaaacaccgtcatacactttgccttttacttctgctcttactgcataaactcctgttggcggaatgatatattcagcagataaaccgacattggcagtcggaaagccgatcgtccgtcctcgcttatctccatgaatgacaataccgcgcagctgataaggttttcctaaaagctcacttacatattcaacatctccatttttcaatgcagagcgtatgagtgttgagctgacttttcggtcttgattggacaacttaggaacgatggtggccgaaatacgcccttttccgtactcatcgaaggtttccattgtgcctgcaccaaaacggccaaacgtaaaatcaaaaccagctactgcgtgctttacattcagctcatctaaatattgatcaacaaactcttgaggcgatagcgctgcaaagctttcgctgaactgcacaatgtataaatagtcagcgcccagctgttcgatgaaatcaattttatcctcaagcggcgtaattaagtccttgggttcacgtgctttttgcaaaacatgtgatgggtgcggatgaaaggtcatgactgctaaagccaaaccttcttttctcgcaatgttttttgctgcatcaatcactttttgatgtccgaggtgaacaccgtcaaaataccctaaagccataacagacgggtcttgatccttttgattcaatgtatgtgggtgtgaaatatgtatagtcttcacgagatggtcaccttttctttaagattgcttgtcctgagataagatcttcaccggcttcattagattctgtttggtcgggtgcttcatatatatcgccatacaccggcctgaaggagcaaagacagcgacacgatcttcctctgcgaaatgagcgaattcatcaggcattggcaggactgcaccgttttccactttacttgctaatgtatcatttatctcccatttcggcaaatgattgagcgcacgctctatcgggacaaggtgctcatctactgtaccttcttcgcttatatctcgcagctcatcaagggtgatgcactcatctagtgtaaaatcacctgatcctgtgcgaatgaggtgtgacatatgagctgggaatcctagtttctttccaatatcaaccgctaaggttctgacatatgttccttttgaacataaaacggtgaatctaaatgatacttttccattttcaaataaagcaggtgttgtccgctcgatacggtgaaccgtaatttcacggctcggtcgctcaatttcaatgccttctcttgcatattcatagagctttttcccgccaattttcactgccgaaaacataggtggaatttgttcaatggttccttgaaactgtttcagcacagcatcaatttcttcttctgagatgggattttgcacctttttttcttctacgatctcacctgtttggtcttctgttgttgtagaaaaaccaatcgtgatttctgcgtcatacgtttttgatttatctgttaagtattcgacaatcttcgttgctcttccgatacaaatgggcagaacacctgatacctcggggtcgagggtacctgtatgtcccactttttttgtatgcaggatctttctcactttgaacacacagtcgtgagaggtcatccctctttctttatgtaataaaagaacaccattgatcatctgcgctctctcctttcgtaaacgatgaaaaaggacagacgatcatcgcctatccttatttcaacgtcttattcatgatcttttgtgtttagttcagcaattaggctttcaattcggtttccgtaatccacggattcatcgaattcaaagtgcagttctggtgttttgcgaagtctaattcgattgccaatttcagaacggatataccctttagcctttgcaaggccttttaaggtttcctctctttttttctcgtcaccgagaacagaaatgtaaactttcgcaatttgcaaatcaccggatacttcgacatcggttacagtcaaaaagccgattcttggatcttttagctttctgcctaggatgtcgcctaattcctttttcatctgctcacccacgcgggttgctctcatactcatgatcttatcacctctaattaaaaccactcagttttcgtgatcgttcgttcaatttcaggaaaagaatcaataaagcttaaaacacgctgcaattccttttccacttgaacccgggatgaggaaattacggcgattccaattgatgtacgctgccatgtgtcctggtaatccatttcagctatggttacattgaatttatggcgcgttcttgtcaatatacgctgaagaaccgcacgtttttccttcagtgaggaggcatcataaatgatgcactcacattcggtataaccgatcattttctttcgatttcttgcataacgaatgattccatgacatcaccttcacggatatcattgtacttcttaatggtaataccacactcatagccttgtgaaacttctttcacgtcatctttgaatcgttttaatacgtcgacttcgccttcaaaaataacgacgccgtcacgaattaagcggataccactatctcttgtgatggttccttcagtgacataaccaccagcaattgtaccgattttagatactttgaacgtttgacgaacttcaacttgaccgatgactttttcttcatattcagggtcaagcattcctttcatcgccgcttcaatttcatcgatgactttataaataatgcggtgtaagcggatatctacgttttctgtttcagctgtgctcttcgcatttccatcaggacgtacgttaaatccgatcacgatcgcattagaagcacttgctaaaataatatcagattctgtaatcgctccaacacccgtatggatgattttcacttttacgccttctacttcaattttttgaagagcggccgtcagtgcttcagcagaaccttgtacgtctgctttcacgatcaagttgatatctttcacttcaccttgtttgatttgctcaaataggtcatctagagataatttcgctttgtctgaacgctgttcatcaagctgtttcgaagcacgcgcctcacctacttgacgagctgttttttcatctttgaacacgaggaactgatcccctgcattcggtacatcgtttaaaccagtgatttcaacaggtgtagatggtcctgctgttttcacgcggcgtccgatgtcattaaccattgcacgtacacggccaaatgtatttccgacaacgattgggtcacctacatgaagtgtaccagtttgaacaagaagggttgcaacagatcctcttcctttatcaagctcagcctcgatgacagtcccttttgccgcacgatttgggttggctttcagttctccaacttcgctgacaagaaggatcatttcaatcaattcatcaatgccttcacctgtttttgcagatagaggaacgaagatcgtttcgccgccccaagcttctggtactagaccatgctccgttaattcctgcatcacacggtccgggttcgctgttggtttgtcaattttattgacagcaacaatgattggcacttctgctgctttcgcatggttaatcgcttcaaccgtttgcggcataacgccatcatctgctgcaacaactagaatagttgtatccgttacctcggcaccacgtgcacgcatcgttgtaaaggctgcgtgtccaggtgtatcaaggaacgtgattttcttgccgttttcttcaatttggtatgcaccgatatgctgcgtgattccaccagcttcgccttcaacgactttcgtcttacgaatgctgtcaagaagcgttgttttcccgtggtcaacgtgtcccatgatcgtcacaactggagggcgtacttgcatatcttcttctttatcttcaacttcatacttttcaagttcagtttcttctaaaataatgacttcctctactggaacgccatattcagaagcgattaattcaactgtatctttatccagctcttggttaatggttgccataacaccaagcatcatcagctttttgataatttcagctgtttcttttccaagctcttcagccagctggccgactgacattgaatttgtaaattcaattttttcaggaagctctttcttaggcttcacaggtctagcttgctgatgctgcgatttgttatttccaccgcgtttatttttgtttttgttttggttgttgttttttttgtttttattaaattgattattctgcacgtcattcttctttctatcattgtttttgttagatgattgttttttttgttctgcgggtttctcgttagctgtctcttttgctttggcttttttatagatcgcgtctagctttttcacagtgtcgtcttcaagcgtcgccatgtggttgttcacttccacgttcatatccttaagcgctgctataatatctttacttgaaacatctatggcttttgcgtattcatatactctcactttagccattcgttcacccccaaataaattaatcgagcaagcttataagcttctttgcgaagccttggtcagtgacagcgacaactacgcgagcttctttcccaatagaacgtccgagaacggaacggtcttcaacttttctaaccggaacattataaaatttgcatttgtcagatacctttttctctgtgttcgatgaggcatctgctgcaagaagaaccagcttagcacgcgcatgtctaatttctttgatcacaagatcttctcctgacacgactttacgagctcgatttgctagaccaagcaaaggataccattcagattgagtcatttggttttttcaccttttcagctagttctagtaattcttcaaatatgtgttcgtcaatctgtgtctgaaattgctgctgtaaactgcgtttgttctttgccgcaagaatggtttctttatcgagagaaaggtaagctccgcgtccgttcttttttccggttgcgtcaacagacacttcaccttctttagaacgaacaacacggatcagttctttctttggtttcatttctcccgtcacgacacattttctaagcgggattttttttcggctattcaccttttacatcacctcttattcgtcagattcctcagctactggttcagcctctaagaaaagagattcagagtcttcagttcttgggaaaataccgagttcccttgcatctgtttcacttttaatgtcaattttccagctagtcagctttgctgcaagacgagcattttgacctcttttaccaatcgctaacgacagctgataatcagggacaatcactgttgtcgccttatcttcttcattcacaataacatcaagtacttttgatggacttaatgcattggcaacaaattcaaccgggtcattagaccaatggacaatgtcaattttttcgccttttagctcgttgacaattgcttgtacacgctgaccttttggtccaacacaagaaccaactgggtcaacatcaggatcatcagtacgaacagagattttagaacggtccccagcttctctagcaaccgatttaagctctacagtaccatcataaatttctggcacttcaatttcaaataaacgctttaaaagacctggatgtgttctagacacataaatttgtggtccttttgttgttttttcgacttttgtaataaacaccttaatgcggtcatgtggtttgtagtcctcatttggcatttgttcgttgaccggaagaagggcttcgattttgccaagtgacacgtaaatgaatttactgtcaattcgctgaacgattcccgtcataatgtcttcctcgcgatcgataaactcagtgtagatcacacctcgctctgcttctctcactcgctgcgtcaccacttgtttcgcagtctgagctgcaatgcgtccgaaatcttttggcgtgacttcaatttcaacgacgtcacctaccatgtaattcgggttcatattggctgcatcatctacagagatttcaagacgagaatcatacacttcatcgacaacatcttttcttgcaaatacgcgaattgttcccgtttcgcggtttaaatcaacacgaacattttgcgcttgattaaagttacgcttatatgcagaaatgagtgcagcttctatcgcttcaataataatttctttactaatacccttctctttctcgagaacagtcagggcatctaacaactcactactcatttttatggttcccccttatatcaatgaaaaggttaattgaacgaaactgctaatcttgcgttagctattttttcgtatggaatattgatctctttctttcttgtcttgatcttcactgtcactgttgcaatctcaccatcaaagcttgtaagctcaccttcaaatgctttttcaccatcaattggttcatatgttttcatgaaaacattttttccaagtgctttttcaaaatcagcttttttctttaatgggcgctccgctccaggagaggacacttcaagaaagtagttttggctaatcggatctgcctcatcaagcttttcgctcaaggcttcgctcactttggcacattcttcgatatcgacgcctttatcagagtcaataaacacgcgaaggaaccagttttgaccctctttgacaaattcaacatcaacgagttcaagctgtaagccatctaaaattggctgcaccatttcgcttacgacatccactacttttttgctcattctcttcctccttgtgctttcgataaacgctcttatcaatcattctgcataaaaaccctgctttatgtgagcagggggagcagaaaacggatgaataatgtcgagacaaaaattgcctgttcaatacaaaagagcgggtttccccactcttgtctcggtaatcgttagcatttccataaaaactataccatatccaatttttttatgcaaatgaagttccttattctgcaggcattcgtcatcggttcttttcgttcattcttttcgcatgttcactgataagtgctgcctccctgctaccttttatgatgcggaaaccgtcataatccggatagagcgaatcatcgtcctgaatgcttgttaaaatccaaaattgactgcctgcccctccgagccgctcaatcgctgacagccagctttcgtatacgtcaggacgtgctgattgattttgatagccaaattcctctaacacaactggttttccgattgacttcccgcgggtgatatggtcttcaatccatttcactccccagacagcagatttgctccaatgatctgggtacaggtgataggttccataatcgatattaggaagagccgtcaaacggtcccaatcgacgccttctccgcctccgtacaaccaatcttcatgccctggtatgcgaaagaatccttcatctcctactgcaacaagatggtgacgatccagcgatttgatccatttactcatttcatctgcccatttgactagtgcatttcccgttggatctgactgcacacgcggctcattggccaattcccaagtcataatagctggatcgtctttatattgaacacctgtatacgtattggttctttctaatacatagcgcacataatttttgtaagcatgttgaatacgaggatctgtataaaaggcatcatgcgttcctgccccgaaccactttacgtattgattcatcccgccaaagtcatcccaattgttcactagtggaatgacaagctttatctcttcctgtcctgctttataaatcgcataatctagtttttgaaaacctgattcttcatagatccctggactagattgtaaaacggagttttcttgaggggctccgtcgtgaaatccccaaatacgtatgacctttaaattcattgctttcatatcatcgaacactgcatctaccatctttttagatttgtaatgaaaatagtaattatttgtaccagcaaagtaaaatggttgattgttcagcgtaaattgtgtaccagatgtctgcacgtaagcggcggctttaatcgtaagtgaaaaccagccggcccatatagcgaccacaagtatgaagcaggacactctttgagtccactttttcattaacattctcctcacaatctatccttcttcaggtacgatcacatctagctgaagcggtgcttgttcatttgaatcaagttcaattgtctgctgtttcaacattttattttctttgccgattcgaatctcatatgttccatgaaatgctggacatatcacatggccattagcatctgttgtttcaactctttgggtcgtccactcatttagaagtttttcataacgtcgtcctgcttcatttaaagaccaatcataattcacgatagccgcatgctcacctctccaatgggcacctgcccaaaatccccacattagcactccttttacggctggatgactaaatgcgacgcgatataaagcctctaggttatccgctcttctattagcgtcagggtgaacagagtcatactctgtgacccatataggaagaccaagctcagcaagcacatcgagtctctctttgacaatgactggatcgacccgttcttcaaaatggccttgaaccccaatcgcttcaataggtgcgcctaactggcgcagttcattgatatgcgctttatacgcatggtgctcaccatatgagatcacattataatcattcacaaacaaaagtgctttcgggtcaatttttttcgtttcttcatacatccacttccaaatatttttcccaaagcgatctttaaaaaatgaaccgtgcatcatttcattgtttacatcccaatggcggaatcttcccttaaaatgattgcccgcatgctcaagccggtttttcatggcttcatatacttcgtgattcggcagtgacctcagccagcttggattcgcatcctctacctcccaaaataaagcgtgccccctcactggaagttgatgtcgatctgcaaaattcagcatcgcatctgctttttcataggtgactttccctctttgtggctcattcgcataccattttgcctcattttcaaaaacagcccaattaaaatacttcacgaaaaaatcagcatattgttgattaaataacacttggtcattcattgctgaaccaaatgcgaattcatgcctgatttgcttaatttcaacctctatacctgctattggctttttatcgccgtttgtcacgtttatcacaaggtctctttgtctatgctctgagattcgatcattcgcctcttttttccacatcagattgatctgctcattttcgcccttgttgaatgattgatgaagaaagcttctttctttgaccatgtaaaaatccccctatcttcattggatttatatttcttaatcaaactgccggctcaaagaaaccggcagcttaaattccgactgttagttgatcagacgatgatattctgcgtaggcagtggccatatccacttgtgaccagaaacggtgataagtgaaaaccggtgccccgttctcccatttgcctgttgcttcattaaatgaagactgatacttactctcaagtgaaggccatgctggatcttgtttaatgttcggacgaagatcagcaaaactcgtatagactccatttcctcctcgctgcggatcagaaggagtggtgctgcttccaggaatctgattcccttgaccaaatgtcccgttccaaccatttgggaaatacacttcttttttaaagaagcggtcatagtcctctctttcttcttctgttacaatgcccacgccatcattataattccacgccacctcaaggagctgtgcggctgcatctttcgctctgacaccaagcgctgtataatcccctgtttcaagctttgtagcagcagcaaagaaagttaatgccttgactaggctccctaatacgcccgtatcctgagttggatcttttgtgacagctgttaggtttggatttcctgttgcagactggaatccattccacgtgtcaggctgtccgctccaagcaatatttccaggaagccaaaactcgcctggtgcactcgttgcagccacagaaacatttgttccccctagaattctttgtccttggtcatttaagaaataaccctcttcatccgacacaggacggctgccgataaaaatgtaatcgagtgcatagttaacccattttgtgatacaggatttagccatttggacattttcagaagttttgtctccatctttcactaaaatataataaagctctgctacgcgctccatcggccatgcctgcatcccaaaccagttattagaaggcggatcatgataaacaggtgcatcctcgtatgccatatcgtaaaaagtacttcttcccgccggatatgcactatagtctccattccaactattggttgcacctcctgctatcgctccctcttttgattgaagccatacataaaattcaagctgcctttttaatgttttttcccaatcgcttgcaccagtagaggaagatggctttaaaccacctttgtctgaggacaaagcataagcggcgacagggttttgatacccttggtgacaatggctcgctccgatacgccatgaccagtttgcatagtcgccaagtcctccgccccaagaggtataccacgccattaagtaatgacaggcaccctttccgtttccagggtacggattcccttgcttaccgcttccaatcgtttgaaaatacttatcgtacataccgtaacggagaaaatcacccatttttttcgctttatcaagataggttgaattattgtagccgagttcctttgcccaatagattgcttgtattgcacgcgcatcagcatccgtcgcattggtataacgccactgagcagctggtacttgattttcttttgtgaacaagctcataaagccttcatttggcttcccaaacgatttatcatcttgtgatggatgcgggatcgcctcccatacagattcctgcggaccacgctggaacgtgttcacatatgcagctttatgtgatggattgagcaagttcccatatttataccagttatcgacatcaagcagccagtgcattaaatacgtttcatttgttccataggttgatttcaattcaccatcaatcggatcttgaccagcaggacgagctccgctcagctgactaggatattgatccggatatggtttttctgctgcgtaggtggctggactagaagggttgtaggcgctcatatgcggctgttcatcatttccatcttcatttactgggatgatgtatttctccatattgtcccaggctgcctctaatttgctccaatcccctgtgtaatgtccgtacaacacctctagccacagccaataactatatgcttctgacgttgtcatatgcccataatcaggcgcttcgcaaatgagcgtctcaattgaatgatacggaattccttctggtgaaaaatatccattcgcatcacttttaatttgatgataaagcgttaaaaaccgttctctgtttgacaaatccttcaccctttcaataaatcttgatttttatttgtctggaagtgtaccaaatactaaagaaccatcatcaaaaacaggtattctcggtgttttttgcatattggatgttaagccttgaaaggaataatcatttgaggcatcccatatattcgacccatttggcgcagataatcgaaattggatttcctttttatgctctgattctcctccaggaaaaatcgctacgccggtaaaatctatttctgcataatagacgtaagctgatgcgtcatataccttgagcggagaaaaggaagcgccttcattgtaggcggctgtcacttgaatatctttttcagtgaatccctttgcaaagacctcactcagattgacgtaatatctaaaggagagtgtttgactacttctcgccggccatccagaccggttgtatagaaccgccttgacttgagtagaagttgcatcattattcatcactgctgcctctacaaaaaactcatcctctggttgttctttaggcgggaaattgggtagctttgattgcctttttccaaacagctgcaccattttggctatatttcctgtaaaagcggcattatagtccgtcgccacctcgtttgatacataatcagagatgtcgtcatcatattgatcctgtgcattaggtccgccaacgagcgccccataaagagtgtgacgatgattcgaaggatttgtcagctggttagaccatgagccatgtgcagttcggtggtgcggatgcttcggcgggttctggccaaacccaacgacatagcttctattaagcggattatcaccaagcatatagtgagtttggttgatcgcaaacgtttggtatcgattctttttttcttcatctgacacccaatcagcgtagacaaaggctaaaaatgctgcatttgctgtataacgaagcgagccccattgatcaagccatgccaaaccgccaggcgtataagtgattctttcgacttttccattttgaacaaaacccgtcgtccagtaatcgagattacgctctgtcgattctatgaatcggttctctttcgtgattctggcgagtaagatttgcgaagcaaaaaaagtattgtcccacgacatggtaaacgtataatcccaatccttcggccattcctctactgcttttagtgcttgatttaaataggtttcttcatttgttgccaagtacagccagattccgccccatatgagttcatcaatatagccgctccatgaattgtaaaacggctgagcgtttgtgacacaatctgtatattcgccgcgataccggtcagcaaatgaataaagctgtttcgcgtgcgtcagaagctttgctgcataaggggcatctgtctctttaaaaatgatagaacccgctgctaaagctgccgcagtttgggcggccacttctgttccagggcaattttcatcaattttaaaagctggccggctcatcggcatcacttctgccggtccccaccaagcatgatcagcgttcccatcacctacctgcgcccaaaactcgttcggacctgtatgagcttttaaaaaataatctgttgcccacctgatctgatctaagatgtcatcaagcagttctgcctcttcataggcttctcggtattcatatactgtccaagcaagtacagctgctgagtaggccattggaaggccaaatttcacatgatcacctgcgtcgtaccagccgccagttaagtcatgccctacatccttcccatcctctagtccagaatctccccgccagttgagacggctgcttttaggcagctttccagaccgctgcgcttcataaaacaacaaggatttttgaagaacctctacatagttataagatgccatttccgtatgactcaccccttctttttagtcaaacatgaatacacaagccacctccttttattcagaacgtgatttgaacagctttgaaaagaatcaaatatgtttcaaaaataagcatagtaaacagcaatcagctttgtgctcatcgaagttgttttctcttgattctttctgtgactgtacccagaatgatcatatgtcgcatgagaacatttcagacggctaaattctcttttttgctctatttgggtagaaagaatgacatacaatctcttctcttaaaacatcacgctaaatcaaggtatatgaatgaattagaaaatgattccaattgatgggaattccttattagttaacataataatattattgtgtacataaaaaagaacgccctttataagggcgctcttcattggtcacattaaaacaaagaaagttggttttgatcaggaagtgcttctaagcagccttgacgatctaaatattctaggatcgttttcgacacttttccgcgtttttgtaaatcctcttttgaaaggaactccccatcttgacgtgcgcgcacaatatttaacgcaacgttcgttccgagaccagggattgagttgaatggcggaatcaatccgtcaccatcaatgataaactctgttgcacttgatcggtagaggtccacttttttgaaatgatagcctctttcacacatttcaagggcaagctctagtacagttaataggttcttttctttcggtgatgcatctaaaccttttgagttaatatcatccatgactgctcgaatcgcatttgatccttttgtcattgtttcaatatcaaagtcatctgcacgaacggtaaagtaagccgcatagtataaaagtgcatgatgcaccttaaagtaggcaatccgtacagccattaatacgtaagcagctgcgtgggccttagggaacatgtatttgatctttttacaagaatcaatataccagttcggaacattattattcttcatttcttcttcccattcaggaggaagtccttttcctttacgaacagactccatgattttaaaggcaagtgacggctctaagccctgatagatgagatagaccataatatcgtcacggcacccaatcacttcacttagttcacacgttttattgtggatgagctcttgcgcgtttccgagccatacatctgttccgtgtgataatccagagatctgaacgagctctgagaaggttgttggttttgtatcctcaagcatttgccgaacgaaccttgtcccaaactccggaataccgagtgtacctgttttacagccaatttgctcctctgttacaccaagaggctctgttccttggaaaattttcatcacttcaggatcatctgttggaatcgtttttggatcaattccgcttaaatcctgaagcatacgaataaccgtaggatcatcgtgccctagtatatcaagcttgagcaagttgtcatggattgaatggaagtcaaaatgcgtcgttttccaatcagaacctgtcgcatctgctggaaattgaataggtgagaaatcgtaaatgtccatataatccggtactacaataataccgcctggatgctggcccgttgtccgttttacccctgtacagccttgtacaagccggtcgatttctgcgcccctcatatgaagattatgatctccagcgtagcctttcacgtaaccgtatgctgttttttctgcaacagtaccaatcgtacctgctcggtatacgtactcttcaccgaacagctctttcgtatagttatgggcaatcggctgatattcacctgagaagttcaagtcgatatcagggactttgtctcctttaaaacctaagaacgtttcaaacggaatatcgtgcccatcttttttgtacggcgtgccgcattccgggcagtctttgtcaggaaggtcaaagcctgaaccaacagatccgtcgttaaagaattcggaatgcttacagcttggacatacataatgcggcgcaagcgggttcacttcggtaatctctgttaaagtggcaacaagagatgagccgacagacccccttgaaccaacaagatatccatcatcaagtgatttctttacgagcttgtgagagattaagtaaataacagcgaagccatgaccgataatactttttaattctttctcaatgcggtcttctacgattttcggcaggtcatctccatagatgctgcgcgccatttgatagctcatttcccgtatttcttcatctgcaccttcaatttttggtgtgtataggtcgtctttgattggtttaatgctttcgaccatctcagagactttttttgtattcgtcacgacgatctctttcgctttttcctctcctagaaaggagaatgcttcaagcatttcatctgtcgttctaaaatgaacttttggcagttcatgacggttcagcggatttgctccgccttgtgatgaaattaagattttacgataaattttgtcttctggatgcagataatgcacatttccagttgccacgactggtttattcagcttttcgccaagcttcacaatgtttgtgatgatttcttttaacgcacgttcatctcgaacaagctccagctgcagcagatgctgatacacttctggcggatgaacttctaaatagtcgtaaaatgctgcaatgtcttccacctcatcaggtgatttttgcatcatcccttcaaacacttcacccttatcacaggcagacccgattattaaaccttctcgatatttctcaagctgtgagcgcggaatgcgcggcacccggtagaaataatgaatatgagaaagagaaacaagcttgaataaatttttcagccctgtttcattttgtgcgatcagaatggcatggtaaggacgtgagcgctggtaagcattagactgacccatgttttcattcaattgatcgtgataggcaatatccttttcagccgcatcttttagcatttttagcatgagatagcctgtcgcctctgcatcgtaaatggcgcggtgatgctgcgttagttctatatcgaactttttacaaagtgtgttcagccggtgattcttaaattcagggtaaaggaaccggccaagttcaagtgtatcaatcacagggtttgacgctttatctgtttttaacaggcgtttgtacgctgtatttaaaaagcccatatcaaagcttgcattgtgcgcaacaaggatatcttgtccaatccattctttgaaatcccgtacgacatcgacgacatccggagcatctctgaccatatcatccgtgatacctgttaattcgatcgttgtcgctgataatgggtgatgaggatttgcaaatgcctcaaaacggtcaatgatttctccgccctttattttcactgctgccagctcaatgatcgtgtcataaacagctgaaagtccagttgtctctacgtcaaatacgacatacgttgcatcctctaacaaacggtgctctggattataggcaataggtactccgtcatcgaccaagttgatttccacaccatacatcattttgatgtcatgctttttacttgctgcatacgcatctgggaaggattgtaccaccgcatgatccgtcagggcaatcgcttcatgtccccatttttttgcttgttccaccagcctgccgatgccagtaacagcgtccatttggctcattggggaatgcaaatgaagctcgacgcgcttttcaccctcaggagccgtatcttccttcagctgaggtttcatttcattgacgtcattggcaatcatgacaaggtctctaacaaacgtatcgttttgaatgcttcctcttgctttgacccacatgccttttttcaatgatttcatcagctgtgcatcttctttttctcttgcaaacattttgattaaaatactgtttgtataatctgtaattttaaagatacaaagcgttctgccgcttttcagctcacgcgtttctgcatcgaatacgtagccctggacggtgattcttctttcctcgtccataatactatcaagcgtacgaatttcttcattgtctttaatttgatagccaatcatgagagggccagacggaccttcctcctgctcctcactttccttcttctccatctcagtgagggcttgcatcgctctttcttgatcttcagcaagcttttgttctctgaacttctgaatctcttgatctgatacaaaaatttctgtatcaaattggagttctggaaagcctacttgtttaaaagcagcctggagcattggactgtacttcttcttgatggccaaagcctctgtttcgctttttgttttaatgatgattttatgtccagacagcgatggtttttgctgctgaagcaagctgataattggaggagaaattccttgaagctcttccacacaatgtgaccaatacgattgaacgagctcttcagagatgctcggatcattgacttcaatcgtacaagtgacttgtgcaatatgagaaaatgcattcgtcagcctgctgagaaacatcgcatacaccttgtaaggcagaagcgccttaaatttaaaaaggaaatgccacgttttcgtcgccttatgcaccgtcaatttgacgatttctccttcttcaaagtaacgactgaggtcatcatctgtcatttgaatctgattgagtaatatatgaaattgccgccgtgtgatcggtaattgttcatccaagacaggaccctccttttgtcaatcagaaaggtacctcttttctacaggaggtaccttcatttttttgttcgttttttatgcttggcgtataaatgaaatcagctcatcaacagatacttcatgtgattcacctgattttctaaacttcacttcaacaatgccttcttctgaacgttttccgcagctaatgcgaattggcagcccaattaaatcactgtctgcaaatttcactccagcccgctcctggcggtcatcgaaaagtacgtcaaagccctcatcttctaagcgctcgtataacgtttcagctagctctttttgagcatcgtttttcatatttaatgcaaggaggtgaaggtcatatggcgcaacagcttctggccaaatgattcctttctcatcgtgatgctgttcaacaactgctgaaagagttctagaaataccgataccatagcatcccataatcattggctgtgctcgaccattctcatcaaggtacgtcgcatccattgactcagaataacgagtgcctagtttaaagacttgtcctacttcaatccccttagcaaactggattgtgccttctccatctggagaaacgtctccttcttgaatcaaacgaagatctgtgaattctttcactgacacatcacgcgcaggattgacattgacatagtgataatccgcttcgtttgcacctgcgacagcatttgtcatgcctttaaccgcaaggtcggcataaatatcgacttctgcttccagcttcactggaccaacaaatccaggctctgttccaatgacttctagtacttcttcgcgagtagcaagctctacaagctgtgctcctaccaagtttttcactttcacatcatttacttcatggtcgcctctcgtcaggatgagaacatacgcatcatctgctttaaacaaaacagacttgatacaaagagaaggatcaacttctaaaaattcagcgatgtcttgaatcgtttttgcttgtggtgtatggactttttcaagttctttgaagtccgcaggatttgcttcttctccttgatatacagcttcagccatttcgatgttcgcagcataggaagatgtgtcagagtatgcgattgtatcttctcctacttctgacagtgccataaactcatgtgtatcttttcctcccattgcaccagaatctgcaataactggtctaaaattaagacctacttttgagaatacattggagtaagctgtaaacatcttgttgtatgtgtcatcaaggctttctggtgaagaatggaatgagtacgcatccttcataataaattcacgtccgcgcagcagcccaaaacgcggtctctgttcgtcgcggaattttgattgaatttgataaagagttaaaggaagcttcttatacgattttacttcgctgcgtacgagtgatgtaatcacttcttcgtgcgttgggccaagtgcgaactcacggccatgacgatctttcatacgcatcaattctggaccgtatgtataccatcttcctgactcttgccacatttctgcctgctgcagcactggcattaacagctcagctgctcccgccttttccatctctttgcgaacgatggattgaatatgttggatgactttatgagcaagcgggagataatgatagattccgcttgtattttgtctaatgaacccagctcttactaagagctggtgactttttgcctcagcatctgccggcacctctcgaagagttggtatgaaagtcagggattgtctcatgtcgttacacctcatttatgaaataggacttctcacaaaaactcttgtttcccgtaatgagaaacaagagacattggttttataaaaataatcgctggatgtcattccacgtaaccactagcattaacagcatgaggaatgcaacaccgataaagacaacaagtgcttctttctcacgattaattggtttaccgcgaatggcttcaacaaacaagaatagtaaacgtcctccgtctagtgcaggaatcggcaataaattcacgatacctaagttaatactaaggaacgccgcaaactgcattaatgttaacacaccttgcttggctacttctcctgtcatgtcatagattccaacaggacctgctaacatatctaatgaaaattgtcctgtgacaatcttttgcaagttcgttaaaatcaaacctgctgttgaaatcacagttgttcctgaggatgaaataaccttcagaaatccattttccgttggcggataagagccaaaacggccaatgttttttccgtctgctttcacagcttctggtacaacctgtacagtgctttctttgccatctcggtcaatgacgacattcatttttttctcagggttcttttgaacggtttgaacaacgtctgtccaagaattcattttatccccgttaatggacacgatgtggtctccctgcatgagtccagcttctgctgcgcggccgtctttcgtcagcttgccgagtacagggtcatcaacggtgaccccttgaataaaccctaaagcaactaaaatcacatacgccaagataaagttcataatcggtccagctgcgatcgctttaatacgctgccataccgtttttgatccaaattggcgattgtacggtgcgatttgaatctcttcaccatctgcaatataaaagcttgtttgactcacattgtagccagtcaaattatcttcatttccagcttcatatcctgagattctcatggcatgatctaaatcaatctgctccacttcgatgacaagagcatcaggatatttttctttatcatttaaaatgattttttctacttcattttgctcattgaataagagccccactgtatgacctggtttaatttcaatgacttcagggtcctctcctgccattttaacaaatccgccaatagggagaagtctaatggtataaacggtttcctttcgtttaaaagagaaaatcttcggtccaaaaccaattgcgaactcacggcataaaatccccgctcgctgcgccataattaaatggccaagctcgtggaaaaaaacgagcgttccaaaaataataataaacgcaatcactgtattcacgaacataccaccttatgtgaggattgattgaacaaagtctcgtgtatctttgtccacttcatggatatcttgcaaactaggcgttgaaatcacatgatgtctgtttagtgccttttcaatcaattcttcaatttgcaggaacgttactttgcctttcagaaatgcatcgactgccatttcatttgctgcattgagcacagcaggcattgtccctcctattttacctgattcataagcaaaatgtaagcagcgatacctgtcaaaatccgctttttggaaattcaattgtccaatctcccaaaggttcaatgatttcgcttctggtaatggcgctctgtcagggtatgtgagtgcatattgaatgggcactctcatgtcaggtgtccctaactgagccatgacgcttttgtcgtgaaattccaccatcgaatggataatgctctctttatgtaacatcacatcaatttgttcataaggtatatcaaacaaccaatgtgcctcaatcacctcgagccctttattcatcatcgtcgctgaatcaatggtgattttcgcccccattgaccaatttgggtggttcagcgcttcttcaaccgtaacaccttcaagttcagttcgttttttatctcggaaactaccacctgaagctgtcacgattaagcgttcaatgtttttagcttgttcaccttgcaggcattgaaaaatagcggaatgctcactatcgacaggaagtaaaggtacatcatatcttttcgcgtactctttaactatatgaccagctgtcacaagtgtttccttatttgcgagtgcaatcgtctttttttgttcaatggcctttaatgttggaacaagcccgacacttccgacaagggcattgaccacaacgtccactgcatcataggtcgctgcttcgatgttggcttcatcacctgcagccattttgacatcgtattcaaatgaatgaccttttagcgtgtgataagcctcttcacttaagcatccgacaaattcaggctgaaactgttcaatgattggtatggccttgtctacatttcggccaaacgtcatggcttttagcttaaatttgtctgggtgctgcctaatcacatctaatgtttgttctccaattgatcctgttgcgcctaatagcgaaatatatctcaaattgccactccttctctcgttcaataagtttctatgaggttagctggcaaacgttgcgagcaataaatataaaaacggcagaacgaataaaaagctgtcaaacctgtccaaaatcccgccatgtccagggagaattgtccctgaatccttcacgtcgtaatgacgctttaaagcagattccacaaggtcgccaagctgcccaaagatactgagcaaaagcgtaataaacataacaagcagatatgatggcaaaaatcctgtaaccgcctgaaacacaaatgacaacacgaccgctgtgacgattccgccgataaatccttctactgttttgtttgggctgatctctggccagagctttcgtttccccatcgatttcccaataaaataggcacctgagtcagtggaccaaataatcactgctgcgaagaagatcgcactcatgccatataagcctctaatttggataaaataatagaaactaacgccaatatataatgtcgctaagatcacaaaagcaacctcatcgaatgtgaaagagtttttgctcaacactgtataagttaaaagaattaagactgcaaataaagcaatctgcatttttgatgcgtctgcgttcgggaagaagctgttctctccgcccattaaaagccaaagcaatattaagctgacaataccaggaaagctaaaaatcgatatctttttcattcttagaagctcaaagagagcgacacttcccattaagtaaatcagcagggtaaatggcatctgtccatatataactgcaagtaaaaagactgcagctgccaacacacccgtcaaaattctttgtttcatctgcaccaccctctaaattccaccgaacctccggccgcggcgctggtattctccgatagcgcctataagatgctcatcagaaaagtcaggccaaagcacatccgtaaagacaaactcgctgtacgcaatttgccaaagcataaaattgcttaatctaatttctccacttgtgcgaataagcaaatccggatcttgaagagattctgtcattaaataagctgaaaacatctcttctgtgatgtcttctgcttgaagcttaccttctttgactttttcagaaatttgtctgcacgcggagacgatttctgtgcgccctccatagttgagcgcaaaattcaaaacgagtccgtcattattcgccgtactctttactgcgttctctaccgctcttttcgtatgctgcgggaggccgtctggatcacctgttaagcgcacacggacattttcctcgatgagctcgggtaggtagatgttcaaaaattcctcaggaagtttcattaaaaagtctacttctaattttggacgtttccaattttccgtagagaaagcatacaaagtcagcactttgacattcagctcatttgcaagctttgtcatgcgcttgacgactttcattccttcatgatgtcctgctacccgtggaagagcacgtttttttgcccatcttccgttcccatccatgataatggcgatatgttcaggaatttctccatttaatatgtcttcttttgtcagactttctaagttggaagctgcagtttgctgattcttccaatttttgagtatattgagcatgagattcctccatcacccaaaaaggttgcgtttccgctaataatatagtcaccaacagtattaacaaaaaaaccccctgtaaacatgaagagggtcttttcactattatctattgtacatagttttttcttaaacttccatgatttctttttctttatctttcgtcacgtcatcaattttagcgacatattcatctgtcaatttttgaacatcctctgttgatgatcttaattcatcttcagtgatctcaccatttttctctagctttttcaactcatcgtttgcatcacgacgaacattacgaacagctacttttgcttcttctgaatattttcttaccactttcacaagctctttacgtctttcttctgttagtgcaggaatcgcaatacggatcacatttccgtcacttgttggcgtgatgccaagatcagacttttggatcgatttttcgatatcaccaatagctgttttatcataaggtgtgataatcagcatacgtgcttctggcactgtgattgacgcaatttggttaagtggtgtttgtgcaccgtaataatcaaccgttactttatcaagcaatgaagcatttgctctgcccgcacgaacagttgcaagttcacgtccgtatgcttgaacggctttttccattttttctttcgtttggttcaatacttcttttgacacgttatttccccctcacaatcgttccaattgattcgccatttacggcacgtttaatatttccttcttccataatagagaatacgattaatggaatgtcattgtccatacataatgaggacgcagtagaatccattactgcaagcccttcttttagcacatcaagatatgaaagcttgtcatattttactgcatccgcatctgtacgaggatcagcactgtagacaccgtctacattatttttcgccattaaaatgacatctgcttcaatttctgctgcacgaagtgctgccgttgtatctgtagagaaataagggttaccagtacctgcagcaaaaatcacgacacgtttcttctcaagatgacggatcgcttttcttcttatgtatggttctgcaacctgtctcatttcgatagaagtttgtaccctagactgaatgccaagcgtttctaggctgtcctgtagcgcgagtgaattcatcactgttgccagcatgcccatatagtctgctgttgcacggtccattcctaagtcactacctgtcttaccgcgccaaaggtttcctccgcctacaacaactgcaacctctacatctagctctgcaatttcttttacttgctttgcgattgaatgaatgacagttgggttaattccatttccagcatcacctgctagtgcttcgccacttagcttcagtacaatgcgattatatttcggtttgctcatgataacctccaagtgtaaactataccgtctcttattatgcgtaagaaactgccttttgtaaatcaatatcctctaaaaaatagggaacacagtgcttgtgctccctaaaaaagccccagagagcttttcaaacattattttttcacttggctcattacttcttcagcaaagttgtcttgacgcttctcgatgccttcgcccacttcatagcgaacataagtttgaatgcttgcgtttttcgcagctactacttgtttcactttttcatctgggtttttaacgaaagcttggtcaagtaagcaaatttcttcgaagaatttgtttagacggccttctaccattttagctacgatgttttcaggctttccttcttgaagcgcttgctgtgttaatacttcgcgctcacggtttgcttcttcttctgacacttggtcacgagaaatgtatttagggtttacagcagcaacgtgcattgcgatgtctcttgcaagctcttcgtcagttgttccgttaagaacagctaacacaccgatgcgtccgcccatgtgtaagtaagaaccgaatgctgcgttatcttctttcgtgataacagagaaacgacgtagagtgattttctctccgattttcgcaattgcagatgtgatatgctcttcaactgttgaaccgttttccattttagaagcatgagcttcttcaattgttgcaggtttagcagcaagcaaatgatcagcaagttcgttaagaagtgattggaacccttcgtttttcgaaacgaaatcagtctcagagttcacttctaggatcacgcctgtgttgccgtcagttttgataagagttaatccttctgcagcaatacggtctgcttttttcgcagcttttgcaattcctttttctcttagaagatcgattgctttgtcgatgtcaccatcagtttctgttaacgcttttttacagtccatcatacctgcaccagttttttgacgcagttctttaactaattgagcagtaatagccattttacatttcctccttctatgttaaaacacggattactaggtgaaaaaaaggtgataaaaggcatttccctcttatcaccttttgaataggttacgcagttgttgtttcagtttctgtcgtttcttctacaacagcttcttcttcgccttgtttagactcaagaatcgcatctgccattttagcagttagaagttttacagcacggattgcatcatcgtttgcagggatcacaacatcaatttcgtctggatcacagtttgtgtcaacgataccgatgattgggatattcaatttacgagcttctgcaactgcaatacgctctttacgagggtcgataatgaaaagtgcatccggaagacctttcatgtctttgattccgcctaggaatttttcaagacgttctaattcttttttcagttgaacgacttctttcttaggaagaacatcgaatgtaccgttttcttgcattttttcaatatcttttaaacgtttgatacgtttttggattgtttcaaagtttgttaaagttccaccaagccagcgttggttcacatagaacataccagaacggattgcttcttctttcactgaatcttgtgcttgctttttcgtaccaacgaaaaggatttttcctccgtcagcagcaaggtttttcgtgaagttgtaagcttcctctacttttttcaccgttttttgaagatcgatgatgtagataccgttacgctctgtaaagatgtaacgcttcatttttgggttccaacggcgtgtttggtgaccgaagtgtacaccagcttctagcaattgtttcatagaaataactgacatgttgttgcctcctaatataatggttttttttcctccgcttaagtcatgttcacataaaactgcgccacggcagcaccttcatacgaatcattaagcgtgtgtatttaacaccaagaaataatataacacatgatggactgacaatcaagaatcctttacagctttccgctaaattttaataaaagctcgatttctgtcttgccagttttcagttctttcgctatttcttctagcgaatgccctttgtcatataaggtcttcacttgatcctcgaatgtttcttctatttcactttcagaaggcacagaagcttctgattcaaaatgtggaacgggttcgtttaccttctcttcctgcacttctacctcgctaaggagagccgacaagtgctctgggactggatcttcactttctaccgattgctgggattcaattggtgtttgtggctgctttggtgtctgaaaatccgatttcagctcttcagcagaaaaatcaggggaagcggctgccacttttgatagtttgtcattctcttctttgacttccatcaaaaatgcagccagggtattttccgtttcttctagaagttctcgctgcttttgttcagttgccttcagcgaattcattctcgtatataaaatgatcacaaaataaataagtgcagcatgaagcatgaagctaatcagccataacatattttttcactcactaactctttaagattgaatggctttatcaagcagatgcttcagcttgaacaatgcctttgaatgaatttgcgaaatgcgtgaggtcgataaattaagcacgtgaccgatttccgttaacgtcagttcctctttatagaatagactgatcacgagcttttctttttccgaaagctcggtcattttttcagcgagctgttctattaattcatctttcagcatcttttcttcaggtgtcacagttttctcgtcgcgaatcatgacttggacgttttcaccgtcttcttgatcatgcagcttctcgtcgattgaaagcagatttgcaaagaaaccttcattcattgttgtgacaacatcctgttcactcatgccaagttcctctgccacttctgtcggcgtcacatttcgtaaataacgttgttcaagcttttcaatagccgcttctactttttttgttttttctcttgatgtacgaggcagccagtcctctttacgaagaccgtcgatgatggccccgcggattctgaaggatgcatatgtatcaaacttcagatctcttccggggtcgaatttttcaagggcatcatataaaccgagcatccctagactgatcaagtcttctttatgcactgacttcgggagaccgatggaaattcttccaacatgatatgtgacgagcggcatatagcggcgcataagatcatctccagcagctgggtctttccactctttccatctagcccatagcgcctgatcttcgtaatttaaggattgcatctttctccccctatacttccttagttatatcttcataatgccttgcttcacagtgcggatctcaagctctgtcgtaagcggatcaaattcaatcgtacggccattgttcccgcccgtatcctctctaatgatcgggatgcgataaagagacagatgttctttaacagctgatacgtttctaggtccaattctcattagatcattggttgacttaaacttaaacatttctgcgccaccagcaagttttgcctttagcgcatgtttgcgcgctccttctttaaggagcagatcaattgtatgcttgacacctgtatctgcatatttagccaagttctccactgccccttttgcaagggatgagtctggaagcatgacatggacaagacctgccagttttttttcttgatcaaacagaacaagccctacacaagaaccaagtccggatgtccgaatgcggtccggtgttttcacaagctgaacatccgctataccaacctttacaactgccggaatctgaacgttcattacaggttacctaatgctttgaatagtttttcaaacgattcaaagtctggtaatagaaacatatttcctttcagctcttgcttattttgatcatcaaaaatcgatgtatcaatcacaattgcctgatcacctagagggctgaattgtattaacccttcgctaatgacagccccgaacatatcgagcgtaacatctggaacacttgggtgaagctgcaattttgttaaatcggcaagggctgataaataagagcctgctaaaatatttcccagctcatgtagtgctgacgtccccatcacatgctcgtgaatagtatcaatatcaaatgacggatctcgtacaagctctcttacgaattgctcggcttgctcaaagggcataatgaaaaagattgagccggataaatctccttccattcgcaggaaaatgcttgcaactgggaggtctgcaccgccaaagaaatccattaattcttcaaacgagagaaccttgacaaacggaacagccatatctattttgcgatccaataggctggcaagagcagacgcggcgtggcctgctccaatattcccaacctctcttaatacatccagctgttcatcttttatttcattgaaaatgctcatttcacatcctccttaatgaacaggtgcatcttgaacgctcttgtcgaggacagcaccaggatgaatgatattaaatagacgctgatcatgcttaatgatacctgtcacccatgattgtccttctttttcagctgattcaggagaagattctacttcttcttgatgaactgtaatgacgtcatttgcttcatcaacaatccagccgacttcaatgtcaccaacttgtacaataatcattcttgtttcatctgtaatttcgttgtcacttgatccaagtctcactctaagatcgatgacaggtgtcacgacaccgcgcagattaataacaccgcatatataaggggcaacgccagggactcttgtcggctgctgccatttttcaatggactttacttctgatactgaaatggcgtattcttttttgtttacgataaacacaatcatcttttcgccagttttgatatctgtactcatttcagaccgctcctctattgttttttacttgatcagtgcattacagtcaacgatgagtgcaacttgaccgtcgcctaggattgttgcgcctgaaatcgcaaacacgtttggcaggtaatctcctagtgatttcaatacaacctcttgctgaccaataaatgaatcgaccacaaatgctgtcagcttatctcctttacgaacaacgatgatgtgcagttcttcctctaattcattcgcatttggtacgtggaattgtttcttcaagtacacgaccggtacgataaatcctcggaaatcaatcacttcacgatcatgcgtttgaaggatgtcgcttttcttaatgacagccgtttcaataatagaagaaatcggaatcgcaaatgtttcctcttccagtttcacaagaagtacagaaataatcgataatgtaagcggaagctgaatcgagaatagtgagccctgtccttctgttgagttgatactcacagatccgcccagtgattccagcttgtttttcacaacgtcaaggcctacaccgcggccagagatgtcagaaatcgtatcagctgtagagaatcctgctgcaaagatcaatgaatcaatttgatgatcttcaagtgtctctgcttctctttctgtaataacgccgcgctctaatgctttttcaagcactttcttacggttaattccgccgccatcatcttctacttcaatgaagacgtggtttccgctatgatacgcctttaatagaacggtgcctttttctggcttgccttttttcacacgttcttctggcgattcaattccgtgatctagactgtttctaagtaagtgtaagagcggatctccaatctcgtcgataactgttcggtcaagctctgtctcagcaccttcaatgatcagttcaattttcttattcagctcttttgtcaattgacggatcatacgagggaatcggttaaacaccgtttcaacaggaaccattctcatgttcaggatgatcgattgcagatctccagaaatacgtgtcattctttcaactgtgtctgtgagttcattattttctaattctttggcaatctgttctaaacggcctctgtcaatcaccagttcttcaaatagattcatgagagaatcgagacggtcaatgttgacacgaatcgtttttgttccgccggcagctgcaccgttattgccatttgcttttggcgcatcgtttgctggtgctttcgcagcaggcacagagacttcttctttttcctgttcaggttttgcctcttgtttttcagctggagccgcttcttcaaatgcagaaacttctgagatctcaacttgttcaacttctgagatcgtcatcacgattttcttcacttcgtccattggttgtttagataaataagaaatactgaattcagattcgaaatcttctgattctaaaagttctgcatttggaactgttttaacgacttcgcctgcttcgttcagtctttcaaagatcatataaacacgaacggcttttaataagcatgcgtcgcttaatgttacattgagttcataacatttaaagccttgttctctcgcttcatcaagcactgttcgttcaaattcgttatagtctaaatcgttagcagccgctgatacatcagctgtttcaacactaggagctgcctcagcatggcttcctgtcacatctaactttttactaatctctgtgacatcgcgtttcccatcgccgccttctgcaattgattgaaccattgcttcaagatgatcaagcgcttcaaacattgtgtccattgactcaggtgtgacaatcatttgttcatttcgaatggcatcaaacatgttttctaagtgatgtgttagctgagccatatcagcgtagcccatcgttgcactcatgcctttcaatgtgtgagccgctctgaatatatcattcactagctgcaagtcggttgggttcttttctaaatcaagaagtttttcattacaagtttgtaagtgttctctgctttcatctaaaaagatatctaagtattggtttacatccaacgtgttcacgccctctctttattcatggagcttataattgcatgtgcgatgtcatccacatgccttgtttcatgtgcaaggcctgctttaatgactgatttaggcattccgaaaacaacacatgattcttctttttctgcaatgacttttgtatgaccgcttgcgaccatttttttgacaccttctgtgccgtcactacccatgcctgtcataatgacagcgattttctcgtaaccctttatatgactgatggattcaaataaatagttaacagaaggtttgtgccggctttctgtgtcctctggagacagcctgatgactaaggatgccccttgttcatgaagtgacatattcattccaccaggtgctatgtaagccactccatttttagcgatgtctccatcttgtgcttctttaatcgaaatttgagataaatggtctaacctagtagcaagtgatgccgtaaatcctgccggcatatgctgcacaatcaaaatgggtgcttctatgtccttgggcagcttcgtgacgactcgttgaagtgctcttggcccacccgttgatgttccgattgaaataatctttcgaagtgagccgctttttactgcttgcgggcgaggtgcagccaccggaatcggcggcttcatcacaggcttaggagaaacctgcatttcagtacgtttccttgacagccctgccgcaagcacccgttctacaatttggcctcttactttgtgtaaatcgagcgaaatacttcctgaaggctttgtcacaaagtcaaaagcaccaagttctaagcaatggatggttaaatccttcccttgctttgtctggcttgacaccataatcacggcaaggtcgtgttcagccagaatttgttttaatgcttctgttccatttaaaacaggcatttccacatctaatgtgacgacatctggattcagttccttgatccgttttaaggcatcttccccatttcgcgccgttccgacgacttctatttcttgctcggcacttaggaaatcactaatgagctttcgcataaaggccgagtcatctactacaagcactctaatcacgagtccaccttcctccttttaaaaaaagaggacaacttatctataaacgtatgctgctctctctgtgcctctcttatctgctgttgataaagtgtttctgccagcatcttgatcgttttacttagccttgaatgaggctgcttcatataaaatggaatttgttcggccactgcttttggaaccgcaggatcatccggcacagcgccagcaaataccagttttctgtgtagaaatgatgtgaccactcctgctaattttctgtaggtttcagacccttctgacggggttttacaccggttgacaatgatttgcacagattgttcgaactgatgaatcgctaagtgtttaattgcgctgtaagcatccatgatcgatgttggttctggcgttgtcacaaccactacttcccctgctgataaaacaaaaggcagttgatcttttgaaaggccagcccccatatcaaagaagatacaatcaaagtcgtgcatcattctttccatttcctcaagaaagaacgaccattgatctttatctaaagaaaacagctgttcaagtccgcttccgccagaaatgtaatataggttgttcgttccttgagtcatagccgcttggaaggatttcttcctgacaagaacatctaatatagagctggtcgatgttttccctagtaaaatatcaatattccccataccaaaatcaaggtcgatgactaacactcgcttacctgcatttgcgatagacagtgccatattcagcgtcaaattcgattttccaaccccgcctttaccactcatgacagcaatggtttttgcctgtccgcttataccaagaggagctggtgtgatcgtttgattctgctgaacgagctttcttaaaccttctgcttggtcgggcttcatcattgtaagaccatccttgttaattcaagaggagagccctcaagaatatcctcaggaacattttgaccatttgttaaaaagccaagtccaatttgagagtttgcaatgatttgaaagatggttcccatcgtgtctgtttcatctacctttgtaaaaatgaattgatcgattggaacgtgttcaaagcgtttaaccatggctttcatgtcctgatacttcgaggtcgcactcatcactaggaaactttgaatgctttcattaaatggaatgatgtctgtcagctctttgatatacgcttcttctttaaagttacgacccgctgtgtctacgaaaatatgatcatactctttaaaggtctcttgagctttcacaaaatcctctctagaataacaaacctcaagcggtgcattgagcagttccgcatatgttttcagttgttcgatcgctgcaattcggtacgtatctgttgtaataaaagcgattttcttttgcttctgaatggccgttttggcagcgagctttgcaatcgttgttgttttaccagcgccagttgaaccaaacagcacaatgtattttgaacgaatcatcggctcatcagaggtgtgagccggcagcatatctgtcagcagttgttcaagttctttatgaatttgatcttccttgacagcacccttcgttaaaagaccttttaggcattcgtctcgaatggcatcatcaagaccttgatccttcagcttttgatcgattgccatgagagggtctggcagaataccagcatgccgctcatttctctcatattctaaaggccgagcttgagaaggtactggtttcactgcctcaggcgcaaaaggcggctcttcagaccggtgtggaacgtgctcctttttcggaattactggaagaggaggcgcaggatgtccacctttacccgctctttcttcaaaatcttgatccagtactgcaatcacttcaaccatttgctgtttttttaaaccgaatagctttcgtttcacaacggttttggaatttaaaatgacggcatccttcccaagctgctgcctaatttgaatcgttgcctcctgcattgaattcgctatgatttttttcattttcattagatatccaccactccgatgctctgtacttccacatttgcttctagttcgttataagataataccggtaagtccgggaaatatctttctaacagctgcttgacgtacattctaataggaggtgagcacaatagaaccggcgtttcctgacgaagcgaaagctgttcaatttctctcgccactgattgaatcacactttcagaggattctggatctaacgataagtagttgccatgctctgtctgctgtacactgtcagcaatcaccttttcaactcgacctgagcatgtcacaactttgagcgattcattttctctcgcatattgtgcagtaatctgtcttgccagtgcctgtctgacatactctgttaacaaatctgtatccgtcgttaattttccgtagtctgcaagcgtctcaaaaatggtgacaagatttcgaatagaaactttttctttcagcagttttgcaagcactttttgaatatcaccaactgctagtggattcggggtcacttcatccactaagacaggataactttctttcagatgatcgattaattgcttcgtttcttgacgtccgagcagttcgtgtgtgttttgtctaatcttctctgtgatgtgagtagacacaacagatgcaggatctacaaccgtatagccgagcatctcagcctgatctttttctgcttctgagatccatttagccggaagaccaaaggatggctcgattgtttcgattccttcaatcggatcatcatcaggcgtaggcgacatcgctaagtagtgatcaagcaggagctcgccttttgccacttcgttccctttaattttgagtcggtactcatttgggttaagtgcaatgttgtcccggatccggacaactggaatcacaagaccgagttcaagggcaagctgccttcggatcatcacaattcggtctaacaggtcaccgccttgatttgcatcggctagcggaatcagaccgtagccaaactcaaattcaatggcgtccatttggagaaggtgaatgacgctttctggacttttcatctcttctacctctgcctgctcctctagtacctcttctatttcttcttgatcctgtttgttttttgacatcaagtatgcgccgagggcaagtaaacctgcgatcggtcctgtcaaaagtacgccgattggagtaaacaacccaagaaggaagatcgtacctgctgtgacataaagcatagctgggaatgcaaacagctgttcagtgatatctgaaccaaggttcccattagaagcagcccttgtgacgacaatccctgttgctgttgaaatgagaagtgcaggaatttgtgaaacaatcccatctcctaccgttaataatgtaaagtgggaagctgactcttgaatcgacattccttgctgaagcattccaatgataatcccaaaaataatattaataatgacgatgataatacctgcgatggcatcccctttgacgaacttacttgccccatccatcgcaccataaaagtctgcttctctcgctactttttcacggcgatttctcgcttcactttctgtcagcatccctgcatttaaatctgcatcaatactcatttgtttccctggcatcgcatcaagggtaaatcttgccgcaacctctgaaacacgctcagcccctttggtgattacaacaaattgaatgatgatcagaataaggaagaccaccagacccacgagtatatttcctccaacaacaaatgaaccaaacgtttctacaacctttccagcgtctccagttgataggatagaacgtgttgtagagatgttaagccctaaccgaaacagcgttaagagcaaaagcaatgatggaaatattgaaaattgcagtggttcttgcatgttcattgtggtgagaagcacgataagcgcaagagaaatattaataatgattaaaatacttaatagcattggcggaaacggtatgaccagcatcgccacaattaaaataacactgaataaaacagataaatctcttgctgacatgcctgttctctccttttaaaaccaaaaattcataaaatcttttgtttcgttttataaacatatgctaaaatttctgcgatcgccttaaagtattcctctggcaccgcttggtcgatgtcgacctgatcatagagtgcacgagcgagcggccggttttctacggtcataatatcgtgctctttcgcaatcgttctaattttcaaagccaaaatatctgttccctttgccacaacaaagggcgcgtccattttttcttcgtcatatttcaaagcaattgcatagtgagttgggtttgtaatgatgacgtccgcttttgggacttcctgcatcatccgtctcatggccatttcccgctgacgctgtttaatctttgattttatgagcgggtcaccctcagattttttatactcatctttgatgtcttgtttggacatccgtaagtttttttcataatcaaatttctgatacatataatcaagccctgctaagatcatgagagcacctgctgcatataaccccataatcaaggtcatatttgcaacgaaatgaagggtttcctctgctgttaataaaggaagcctcaggatttcgtcaaagtgcatccaaagtgcaataaatgtggcaaaaccaattaaaccaattttcaaaatggattttaatagctcaacgagggctcgaatactgtatattcgtttaaaccctttgattggatcgagtttttctaatttcggtttgattacttctgtcgaaaagagaaagccaacttgcaaatagttactgatgatccctgccagcataccaacaccaaggattggcatgaggaggagtcctgtttcctgaagcaattccacaaatagttgatgaatattagatgtgctaaccttcattagcatggttgttgaataaaaacgttcaatgagcgcaataatacgctctttcataaaaggcccaataaaaaagaatgataaaaagattaatagaaatgagatggctgtattgacgtcggtacttttggcaacctggccttttttacgtgaatcttgtctctttttcggcgttgctttttctgttttttcacctgcgaaaaattgcaagtctagtctaagccttgtcatcatgacgaaccaccgaccaatgctaagaaattcctcatggtgagtacaatcgtatcaaatgtattttggacaactccgaagatgacgcccatacagatgatgatcataataaaactcacacccattttaataggaagtccgacaacaaaaacgttcatctgcggaactgttcgtgccacaatgcccagtgccaagtcgaccaaaaacaagctggcgacaaccggtgctgagatttgaaaggcaatgatgaacatttggttgaagctctttgcaataaaataagcaaaggattcactgccgaaattcagtgcgtactgatcaactgcaatatactgaaagctgtaatagattccatcaagcagcaggtggtgtgcattggttgccagcatcaatagcaatgtgaccgtataaaaaaactgccccatcagcggcgtttgtgcccctgtttgcggatcaattacattggcgatcgcaaagcccatttgaaaatcaataaatgagccggcaatttgaacagcggacaccatgatatatgcaatcaaaccaagtagaagcccgaccattgcttctttcaccgcaagcatcatataaagaccgtctatgtcgagtgctggcggttccttaatcgtgctaaaactaattacagctaaaaacagtgagaatccaactctgtgtacagccgggatcgttctatgcgctaaaagcggtactgtcacaaaaaaagcggtgattcgaataaaaactaatagaaaagcagggaataattctatgattgacatcgctcgttaacctgcaaatcgatctaaattcgagaacagctctgtcgtaaaggacacaatggttgacagcatccatggaccaaacacaacaagcccaataagaactgcaacaattttaggaatgaacgcaagcgtctgttcttgaatttgggttgttgcctgaaacacactgacaatcagtcccacaataagagcgagcgctagaagcggcccactgacaagcaataccacatacactgatctttcagccatcgtaatgacaaattctgaactcatgttttaagcacctactctaaaagctttgcagcaaagatttaacaatcaaataccatccatcgactaaaacaaataacaatattttaaaagggagcgatatcataaccggcggaagcatcatcatccccattgacatcaggacacttgcgacgaccatatcaataattaaaaatggaataaagatcatgaaaccaatttgaaatgccgtctttaattctgaaatcgcaaaagcaggtaccatcgccgttaacggaatatcttttatcgattcaggtgtatccatttttgcgtaactaagaaataaagccaaatccttctgtctcgtatgtttactcataaactctttaatgggcacttcggctttttcatatgcctgattgagcgtaatgtcatcatttaaaagcggcgtgagtgcctctttattaatctctgagaacgtaggtgccatgataaagaatgtaagaaacaaagcaagccctacaagcacttggtttggcggcattgagttggttgcaagggacgttctaacgaatgaaagtacaatcacaattcgtgtgaaacacgtcattaaaatgagaatgcctggtgcaaccgaaaatacggttaaaagtaaaagaagacggacagacgtgctaatattccctgcaccgctggaattaaataaatcgataaactcattcattttgtttcgggcctttctttctgacttctgattgggtctttttcaattcggctagctgcgccttcaaattggctgaaaaagaagaagtggttggctgatcctgtttctttatctgagatgtgaatttttgaacgatttttggtaaatctgttttgctttccatcgcttcttcgtattgttgcacgatcgcttcacattcttgttcatcatcaatttcttttagtagctggattgagtccgctactccgacaactaatactcgttttcccactttgataagctggactgaacggttttggccaaccgtcgttccgccaatattttcaacatagcgaaatggtttaagtaagcggttttgcttaccaacaaatctcaccaatccatatataagcaggatgacaaaaagtaaggcaccaatcattttgacaaaatccataatggagacagaagaagagggaacttcttctgccggagtcgtttgattgtcagtggttgtcttttctgtatcctttttgctgctcttctcttctttgagccagtcattcactgtgccattttcaggatctttcgtttcagcaaacagtgaggcaggctgtatcgttaagaaaagcataaaactgatcattgctatacatatcaaacgttttttcaacaagtcttacacccttttttagcctaacgttttattaattgcttcaagtacacggtctgcctggaacggcttcacgataaagtcttttgcacctgcttggatcgcgtcaataaccattgactgctgccccattgcagaacacatgatgatttttgcagaagcgtcaatttgtttaatttcttttagtgctgtgatcccgtccatttctggcattgtaatatccattgtgacaagatctggagacgtttctttgtatttttcaactgcttgagcgccgttttctgcttctcctactacatcaaatccgtttttcacaagaatatcctttatcatcattctcatgaatgctgcatcatctacgattaataccttagtagccatttacttattctctccctgtatgtttgtttattttaaattagaaagtctttccgactgacttaaaatatcagtcacacgaacaccaaagttctcatcaatgacaacgacttcccctttggcgacgattcgtttgttaactagaatgtctactggctcaccagcaagtttgtccagttcaatgatacttcctgctgaaagctcaagaacttctttgacacttcgctgagttcttccaagttccaccgtaatggagagcgggatatccatcagcatatcaagatttccaagctggcttgttgtatgctgaggctcactgaatgcttcaaattcaactggtgccacatttacaggtgctgccggctttggcttcgcctgtcttttcggcggagctgcttgcggcgctggtgcagattgcgcttgcggcgctgcctgctgaggttcaggtgtagtcacttgagcttcttgaaccggctcttcctcttgcgcagggtctgttaattctgcaattaaatccttcgcaaatgtaataggataaagctgcataatatttgaatcaatgagttcacctatttttaatctgaaggacactttgacaagcatttcttcagctgggatccggtctgttccttctccttctttcacatcaagtaattcgacgcgaggcggagaaatatcaatctttttattaaagacagtcgacatggatgtcgcagcagaacccatcatttggttcattgcttcttgcaccgcacttaagtgaatctcgcttaaagaagggtcagcatttgtcccgtctccgcccatcattaagtccgcaatgactgctgcatctgtttgctggacgacaagcaggttactcgcgctgaagccttccgtataattcacttcaatcgcgacatacggatgaggaaactcctcattcagcatacttttttgaatcactgtcacagttggagtggtaatctccactttttgatttaatagggttgaaagtgctgtagcagaactgccgaatgaaatatttccaatttctccaatggcatcttgctccattgcagaaaggactgtatcaggctctatatcgtcattgctacctcctttaaggagcgcatcgatttcgtcttgtgataatttacttccgttattctccatcttcttcacctcttatgtcgtgatctagaatttgaatcgcctgtttccgattcacgcggccggcctgtcccaagaatttcggtttatttccgaccataacagtaagaggcgcatttactggtttgtccaaggcaatacaatcaccaatttccaaattcaaaaactcttccaccgtcatttccgattcccctagctctgcgactaccggtatctttgccgtcataatccgtttttcaatggcctttgtttcttgttgttttggttcatttcgttcagactgcatccagtagtgtacagacagcttcggaataataggctctaatacaacatgaggaatacataggttaataaccccgcttacctcgccaatttgtgtattaagagaaatgacgacaactgtttcgtttggtgacaccatttgaacaaactggggatttacctcgaaatctgccatttcaggctcgatgtcggttatagactgccacgcttctctgtaattttccaaagctccctcaaacatgtttgagataatctttgtttcgatttctgtaagtgattctgtcttattatgactaatgccaatcccgcccatcagcctgtccatcatggcatagccgattgttgggttcacttcaagcatgattcttccttcaagcgggctgacataaaataagtttaataatgtcatattaggaatcgaacgaataaattcttcgtatggtacttggtcaaccgagctgacagtaatttgaatatatgatcttagctgagctgaaaagtgcgtggtgagcagtctagcgaagttatcatgaatccttgttaaacttcgaatctggtcttttgaaaagcgaagtgcacgtttaaaatcatacacctttacttttttcgtcgtttcttcttttttcagctcttctgcatccatttcacctgttgatatggcggataataatgcatcgatctcattctgggaaagcacttctcctgacatttcttcacctccatcgtgtcaattaatcgcctctattgcagattaaaggaggttatatatacttctttcaccttgccatcttgcaaatagttattcactttgtttttgactagtgttttaaaatgttctctgccttttttgccatcaagttcatctgcatttgtgtctgataaaatgtcaattacggcgtctttcacttgaaaacttcttttctcaagctcttcttttgctttttcagagtctgtttcaatattcaatacaagtttgaccgcatttccttcagactttaaattggtgataatctcaggaatttcaacagaagcttttgcgacttcatctgctgttggctctttttcagcttttgcttcttctgaaccattcagcagaaaaatgatgcctgctcctattccgccgatggcaataatcatgattagcattactacgactaatttcttcttcattcaaattcctctattccttgattcaatgaaatgacttggatttttctgtagaaagaaatgattttctcttgaagttgctcttcattttctttcacaacgaatttctttccattggctaatgtaatggttgtgtctggaaagctttcgatttgctcgatatggagagcgttcagcataaatcctttgccattcaatcttgtcacttcaatcatattaagcagagaagcgttcatccgctccccctacctcctatcgtttcagattcacaagctcttgcagaatttcatcagatgttgtgatcgtctttgcattcgattggaatccacgctgcgcgataatcatttcagtaaactcgtctgttaaatcaacatttgacatttcaagtcggcctgtttggatgacgcccgttccttcttgaccaggtacgatagggttacttggtgcacctgaacttaacgtttggcggtaaaggttgtcaccaactttgtctaacccacctgcgttacggaaagataccagtgatacttgaccaacggttcttgatacattgttttcaacaaccgaaatcgtcccatctggacctacacttacacttgaaatgccttctggaatcgttatcttttgtccatccattccaagcaggtaatttccatcagaagtgactaaacttccctctgaatcaggtttgaaattcccagttcttgtataaagaatttctccttgactttgaatacggaaaaatccgtctccattgatataaaagtcgtaaggttcatctgtattttgagaagctcctgctgacatgattttatcaatagatgataaagaagatcctaaaccaacttgctttgagttgatcgaacccgagttgttcgtcggtccacctgagcttgaaattgtttgactgaccatatctttaaaagtgatacggctttttttgtaaccgtgtgtattgacgttggccacgttattggctacaacatctaattttgtttggaagtttttcattccgctaattcctgagtaaagtgagcgtaacatttattttcctcctcgaattacttcgttttttctccaactgctgtaacatcccaagggctgattttcgttccatcttctaaatacaggaagtattcattgtttatgtttttaacagatttcacagtgcctgatatatctttatcatccaatttgcccgatacttctttaccgatccaccctacatacgtcgtaaacggatcttggtgtgcaacaaatgtagacatgagctgattcagcttggtgatagaatcgttcatattggtttgctgttctaaagatgaaaatgtcgcaagctgtgtgacaaactcacggtcatctagtgggtttgttggatcttggttttgaagctgcgtgagcaatattttcaagaattgatctttcccgagcgtatctgttttcttttctgcttttgaagaagtgtctgtttgtgtttgtgcgactgttctattcgtagcatcaaccgttgccattagatttcctcctcttcttcatctgacccaacaagagcatccagtacatcttggaattctgcttcctgttcatcaggcttctggaaattctgcccttttgactgttgctgcttgttttcttcgttaaattgtccaaataacggctgttcatttgattgaagcggtatatggaaacgatccacttgaaccgacatattcggaagcgcctgcttgagctgcggcagatgatgctctagcagctcttttgctgcttgtgtcgaagcagtaatcttactcgcatacataccattttgcttcgtcagctgaatcgtgataaatccgagattttctggatttaatcgaactgtaaagcgtccgcttgagttgccaaatggtgtgaatttcatttgcttccacgtatttagaatttgctgatcaaccgttcccggcttttcatcagttgtttgtgtctgctgaacaggggctgctgattgcagttgaaaaaactgcttatgacctggcaaaagcgtatgagtgatcgttttttcagaagcagatgcagcagtgctttgccctttgaccacttcctttttgatgagccattcaagagaggcagcccctttagcaggagtagcaagagtagattcttgtcttggagagaccaattcttttaactctcctaaagcaatcttcaactctttgactgacccttttgcattcgccatcatatggtcgattaactgattaaagtgtttcagctcactttgagacatcgaattcagctttggagctgaaccctgcgagaaaaactgctcttttacttgctgaatcagtttctcatctaccccattttttgaaagaaagtgaatgaagtcttgaccctttgcttcaatatcttgcactaactttgcatcaaagctgagcggctgttgattgagcagttgatatatgaaaaagtggacttgtatgagctgctcactatgttcagaagctggcttatcagcttgatcaccgtaaatggatgattccattttttgaaatagctcttctagtgacttgagatcagacgaatcaagcgtttgaccttgaagtgtttgaagtgcgctaagaaggtctccgttgataccttcttcaggtgagtgcatccatttttcaatgatttgcatcgcatcattgatggaaagagtggcacccgttgtctcagcattcacaaggccgctttgtgcacctgccccgctaagtaattgtttaaacaacccgcttgcagaggccactccgctcccctttggtcccgcgagaccttgagatgattgctgtaaggctccaatatccaatagcttcacttattgtccacccccattttcactttcttttttagaaagctctttcgtaaacgtagctgccttctgaggtgttagttttgctaatatgtctgttagtttatttttgctcagctcttcgaggatcttcaatgcctctttatcacttaattctgataaaattttggcggatttccctgcgtccatgctttcatagatactggcaatcttccctttaggtttctggttagaggctgctgcctcatcagaagttgttcctgacgcattattacctgatgtatcgctcgatgagctgttgtttgatgaactgtcactcgctgacgtattattcgcatcattttcagttgttttttcaagtgaactgattttttgattcagtcttttaatctcttcatcacttgtttttaagtctttttgcgcaatttcaagttcatttttttgctctttaatggtctttttcagttccttcaattctgcatcgctttgattattatgtgaagatgacgtttttgaagtgtcatctgaaccaaccaaactgctaacgcccggaatgtgttggagcggtttctttagatcaaaacctgccatataaaggattgtgccagtcactaacacaagcacaatcaatgggatgatgacaataaacaagatccattgaaatttaccgccgcttgattccttcgttttttccttcttaggcattcatctcgactcctaatgtccttgaaacatgaattggctgatagagatatcatccatttctttcatttcaatggccttatgttcaagggaaaacttttcatactgcttttctttcattttttcaaactttttaaactcaatgtttttttcagttaaatcagattgtttttcattcatttgatggcgtttcatgatcacaagctgctgataatgctgaatcgtgttatctaaattggtcacaaattgctgataatgacgcatttcttggacactcataccacttctcagcttttcttctttgcttttttccattaattcttttttactcatattttcatagagcttttcagcgacttgctcaaatgccgaaacggattgttggtacgctgcgagtgacttgtctttttcactttctttcagttctaagagcttttgaaatttgtattgatatctcactgttttcgtcaatcctctctattcatcaaaccgagcaatacattcacactgtcttcaatagatacagcctcttctacatcctgcttcaaaaatgaaatcagatgaggataagcctgcatagcatcatcaatgtctttcgaggagccttttttatatgctccaatgttaatgaggtcttcagcgttttgataagtggataaaagctggcggaaccggttggccgcctccttgtgatcatgacttgcgatattgctcatcacgcggctgatacttttcagaatattgacagcgggaaattgtcctttgttggctaaagcacgatcaagtacaatgtgaccatctaagattcccctaactgtatcagcgattggctcattcatatcgtccccatcaacaagcactgtataaaacgctgtgatggaaccaagctgattcgttccagttcgttcaagtaattttggcagtatagcgaacaccgaaggcgtatatccttttgtcgttggcggttcaccagttgcaagaccgatttccctttgtgccatagcgacccgtgtaacagagtccatcatgaacatgacattttttcctctgtctctaaaatattccgcaatagctgttgctgtataagcagccttcattcttgtcagtgcaggctggtcagaagttgcgacgacaacaatcgatcgctttagtccctcggtacctaaatccttttcaataaactcacgaacttcacggccacgctctccaacaagagcaatgacattcaggtctgcttctgtctgcttagcaatcatccccattaaggtacttttcccaacaccacttccggcaaaaataccgattctctgaccagtgccgactgtaagcagactgtcgatcactctgacgccaacgcccattttttcacgaataggcggcctgtccatcgggtttggaggtgactgatctgtcgaaacaggtgcaagtccctttggaagcatactgccgtccagcggttcaccgaaggcatcaacaacttcgccaattaagccagttccaactttgaccttcagcgactcacctgtcgcttcaactagactccctggtgaaatattggatgcttctacataaggcatgagcagaatatgttcatctctaaaccctacaacctctgcttttatcggatcgtgcttacgcccctttttatgaatgagacacacgtctccgatagaactttccggccccttagattcaatcatcagtccaacaactcgattgactttaccaaatcgtttataaggatcggcagtttcgatcgtttctcttaacacatcgatgttcatttgtgctcacctgaatcaatgacttctagcagctttcctttcaactgattcatttgggtatcaacactcgcttccacttttccaaagcttgtttctacgtaacaagtcccttttggcgctttttcatccgagtaaatcgcaaggtgtgtatccttttgaaggattctgattaattcgtctttatactccatcacgtgatcgtaatgtttagggtccacatagatggaaatatcgtcatattctttcacttcagaaatgacctgcttcacgagagccaaaaattgatctttcgtgtcctcagccgagtaccaaacgcgtttagcgagttcaaaagccagttccacaattttttctgcggagctttcaattttttcttcgtaatcctgcttggcaagactgacaatgtcatttgcttgatcaagaattgatcgatactgactcatcgcatctgcttcacccttttggaagccatcttggtaaccagcttgtttcgcttcttcaatcagctgcattctttcttcttcaaaatcagcacggcgctgattgatttcagccattgttttttcaagctcattatttgcttgttttactatacggcttgcttgatcttcagcatcacttagtacaagctgcgatgcttctgtttcattgacaagctcttcttcatgatgttcttttttgaactccacttgctgcaaaggaatcgtttgccggccttgctcaggaataacagatgtttcatgtttgataatcctagacaatgatatcgtctcctccgcccctagctatgacgatttctccagcttcctcgagtcgtcttacgatgctgacaatacgggtttgtgcttcctcgacatctctaagccggacaggtcccataaactccatttcttctttgaacgtttcgaccattctctgtgacatgttgcggaagacaatttctttgacctcttcgcttgccactttgagtgcgagcaataagtcatcattttcaacatctctgatcacgcgctgaattgctctgctgtcaagagtgacaatatcttcaaagacaaacatacgtttcttaatttcatcagcaagctcaggatcttgaatttcaagagtgtctaaaatggtcttctcggtcgcacggtctacaccatttagtacttctacaaccgcttcgactccgcccgtttgcgtatagtcttgcgtaaaggttgaagaaagcttttgctcaagaatgcgttccacttcattgatgatctctggagatgtgcggtccattaaagcaatacgtctcgcaacctctgtttgtacatcctcacctaattcagataatatctgccctgcttggactggatctaagtaggaaagaatgagcgcaatggtttgcggatgctcatgctggataaagtttaagatttgttctgggtcagccttccgggcaaaatcaaacggtttcacttgaagcgaggatgttaaccggtttaagatgctgtccgctttgtcctcaccaagtgctttttcaagtacttgtcttgcgtacataagaccgccttgtgatatgtagtcctgcgcgatggcgatgctgtgaaactcttcgatgatttcatcttttttagcagtatctacacttcgtacattggaaatttcaagtgttaatttttctatttcgtcttcagacagatgtttgtatacagatgctgacacgtctagccctaaggaaatcattaggattgctgctttttgtctgcctgttagtcgatttggatcttttctcgacatgtgtattcctcctaatcctcggacagccagctgcgtagcaatttagcaaagtcttctggtttatcttttgccattttctcaagctgatttttcctcaccatttcctctgtttctggttcagtgtcaatatcaggaacatggattggtgtacgttcatcaaactcaaactcttcttcctcttcttttctgcgtttacgcacaagaagaacaatgagagcgataattgcaagtagtagcacaccgcctacaatataaacccagattggaatattgtttgatgggttttctgctgcagtttgctgtttaccgtctaattttgatacagataaaacaattttgttatctaagtctgcttgagtgagcgcttgaccatttgtgtattctttatcaattgacgtgctaatgatcgttgaaagaatctttttaatatcatcttgcctttcagctgttaaagagttcacatcgtttgcagttggtggttcgaccaatgcttgaatgccaacatctctaattttataagggctctctttgatatctttatgaatgcggttgacttcatagttgatacgatcttcgctcttttcgtaatctccgctaccattcgctccatcggcgccttgatagtttgtgacatcatcgtcgcctgttccagcggttccaccagctgctgcaccatttcctgaataagtttcagcaatcttttcagcactgacagcgatgccttgcatgttttctttatcaactggttctacaagatcttcttttcttttctcttcagtaaaatcaatgtctgttgtgaccgatacagcgactttttcttgacccatcattgttccgagcagctgttgaatttttctttgaaggttcttttcaatttcttctttcttctgctgctgtgcatccattccacttgcataggaatcagaactgctgtttaagtcgtagtagttggaatcttggtccataatgacaatgttttctgtctttaaattcggcacactttttgaaataagatgataaaggccttttacttgctgcggcgagagcgtgtagccacgttcaacttgcagcacaatggatgctgatgcattactttgctcttctccaacaaaaacggaatcttttggcaggttaatcataacttttgaatctttaatcccatcaatcgtgttgattagattggatagttctgtctgggttgcgtctactttcagaacatcaaattcattatctgttaaaccgaagccggaattattcgcaaaaaatgagtagtcaatattccctgtcttagggagaccctcagatgcgagtgttacttttaaagagtcggcctgcttttctggaacgagaatcgttgttccattattcgcaagttccgatttaacgtttttgccatctagttcctgtttgatttgtccagcttctgcctcagacaagtctctaaacaatggaaccattttttcagaagaagcaaagatgctaacaaccgtaataatgattgctagggcagcaacgccgccaatcataagtattttttgtaattttgatcgatttcgccaaaactcaactgtttttgttcttaattgcattaaagtacgattcatcttaacccccggtcattccattcagtctttttttgtccgtcagcacctcctacatctgcattctcataatctcttggtacgcttcgactgctttatttcgaaactccgttgcagctgtgagtgtcacactcgctttttgcgaggcaatcatgacttcatcgagattgacatcttttccttgtgcaagtgcatttgtatactggtctgatttcagctgcgattgatttaatgcctcaatggaattcttcagcacatcagagaaattcgtttgacttttaggtgcagccgcatgaacggacgatgcatttgtcaattcacttgcttgctgagcagtttgaagctggaaaggagatattgcgttaaccaattcttttcaccttactttcctatttctaaagctttcatcaacatgcttttattcgcatttagtgcggtcacgtttgcttcatatgaccttgagctgctgatgaggtcaaccatttcctttaatggatcaacattaggtgtttgaacatatccattttcattggcatcgggatttgtaggatcatattgaaggttgaatggagtttcgtcttctgtaatcttcgttgctttcacgccgtttcctaatttactgctcgaattcatacttgagtttaatatagatgaaaacgattcacctgacggctgtaaggtgacgagcttacgtctataaggctcccagttgccatcaacctgtttcgctcttgttgtatccatatttgcaaggttagaggatacaacgtccattctgagcctctgtgctgttagtgcagaggccgaagcgttaacgcctgaaaaaattgacatcacttacctcctgtcaaaactgttttaagagaattgaattttccactcattctttcaaccaacgcattatactgaatttggtttttagcgagttcactcatctcttgatcaatatcgacattatttccgttttcttgatatgaagtacggttgctcgaaacaactgaataattagaccctgttttagaaaaatcaatgtgaccttggtatgtttttttagcatctagcttgatcgacgcatcgtttagcatatcatgaaatgcgacgtttttcgacttgtagttcggtgtgtctatattcgcgatattattgcttatgactttttgcttaacattcgctctgcccaaggcattctcaaggttgcttatcgttccagaaaatatatccaaaaccatatacctccaatcatatgtatttcattccatttaatcatgtcgagatttgtaaaaccatatgttcattgtaagaaataataggattaaagtctatgatgtatatgtaaaaaaaactcgtaatatatatctattttacgagtaggtacaaagacctagattcaaagaactaagaattgtaagggttttcttggaaaaaagagtgtcatttttcggacaaatcctctttttttataaaaaaaaaccctttttagcttgtatttctgctaaaaaggggttttgattaatgagattttaaattttcaagttcaattaaaaatttgttgtttaacactttgatatacgttcccttcattccaagagagcgagattcgatgacgccagcactttctaacttacgtaaggcgttcacgatcactgaacgagtgattcctacacggtcagcaattttacttgccactagaagcccttcgttgccatcaagttcttcaaagatgtgttcaatggcttcaagctcactatatgaaagagaactaatcgccatttggacaactgctttacttcttgcttcttcttcgatttcctctgacttctcacgaaggatctccattccaacaactgttgcaccgtattcagcaagaattaaatcatcatctttaaatgtatcttgcaaacgagacaggattaacgttcctaaacgatctcctcctccgataattggcacaatggttgtcaaacctgattcaaataaatcacggttctcaatcgggaaagctgtatactcactgttaatgtcaagatttgaagatgtttcagggatgttgaatagactctttgtatattcttcagggaattgacggtcttcaagcattttcttcatacgcggattttcaatctgctggttgatcgagtagcctagaagcttccctcttctgcttaatacgaaaatgtttgaatcaatgacatctctcaatgtttctgccatttccttaaaattaactggtttccccgctgaatcttgcagcattgagttaataatccttgttttttgtagtaacgccatgttaatgatcctcctagattactttattcatttgttaaagtataaattgacttaagtctttgttatttgcaatctttcctagcttctcttctacatactgaggggtaatggtcactgtccctagtgtaatatcaggcgcctcaaatgaaagctcttcaaggagcttctcaagtatggtatgaagccttcttgcaccgatgttatctgtctcctgattgacatgataagccacttctgcaatcttatgaatagcatcgtcagaaaattcaagagatataccttctgtttcaagtaaagctttatattgctttaataatgcattatctggttccgttaagattttcacaaagtcttcgatacttaatttatctaattctacacgaattgggaagcgtccttgaagctctggaatcaaatctgatggtttcgccatatgaaatgcacctgctgctacaaaaagcacatggtctgttttcactgccccatatttcgtcatcacagttgacccttctacaatcggtaaaatatcacgttgaaccccttcacgagaaacatctgcagatgatgcaccaccgcttttggcgattttgtcgatttcgtcgataaaaataatcccttgctgctctgctttatagacagcttcttgactgacttcatccatgtcaatcagttttgaagcttcctcagctgttaacgcctttcttgcttctctgacggtcaactttctgcgttttttctttttaggcatcagattgccaagcgcatcctgcatgttcatgcccatttgctccatacccgagccctgaagcatatcaaacatggatggctgctgctcttcgacttcgatcgtgacgtaatgatcttcaagttcgcccatcgccagctgatgagcgattcgctttcttgtcgattcaagttctacttcttcacttgattgatctcgatcacggtcatcttcatcagacccaccaaacagcatctcaaaaggatttttcacagactggctttttttcttgccaggaacaagtaaatgaacaagacgtttatttgcttgtttttctgcctcttcttgaacgtctttcatcttttcttctttgacaattctgatcgctgtctcaactagatctctgaccatcgattctacatcacggccgacgtaaccaacttcagtaaacttcgtcgcttccactttaataaaaggcgcaccagaaatttttgcaattctgcgggcaatctctgttttccccactcctgttgggccgatcattaagatgtttttcggaacgacttcatcctttagcttatcatgtaaaaggcttcttctgtaacggtttcttaaagccaccgccactgcttttttcgcatcaagctgaccaataatgtattgatcaagcttttcaactatctctcttggggtgaacggctttttctccatacgtctcatgtcctttctattcaagctcttctaaagtgatttgatcgttcgtgtagacacagatttctccggcggtttcaagagcagcctttgcaatatctcttgctgtgaggtgatcacctgcatgtgttttgagtgctctcccggcgctaagcgcataattgccgcctgagccgatggccaaaataccgtcatctggttcgatgacctctcctgtaccagagacaagcaggatgatgtctttgttcataacgatcagcatggcctcaagctgcctaagcatcttgtcactacgccactcttttgctagttctacggctgccctctttaagttaccaccatattcttcaagcttcgtttcaaacttttcaaagagtgtaaatgcatctgctactgaacctgcaaaacctgcaagcaccttacctccgaaaagacggcgcactttttttgccgtgtgtttcatcacgacagcctgcccgaaagtgacttgaccgtcgccagccatcgcactttttcctttatgttgaacggcaaagatggttgttgcatgaaatgatgacatgaaaaaacctccttttaggatcgtttaaaagcccttgggtgatgagacatgtacgttttccttaaagaatcttttgatacatgcgtgtacacctgagttgatgataaattcgaatgaccaagaagttcttgaacacttctcaaatctgctccctcatttaagagatgtgtggcaaaggtgtgccttaacatgtgaggatggatatgtaatgtgcctgacgcctttttcattagttcagtgagaatgaatcgaacacctctgtctgtaagaggcgccccgcgctgattcaaaaatacatatgcatcagcacgatcattccccttcgctttcagcttcagccttccatcctctaaataagtgatgagtgcttcatgagcatatgaaccaaaaggaacataccgctgcttgctgcctttcccatgaacaagcactgtatccatcgataaatcaagatcagattcttttaatgaacataactcactgaccctcatacctgttgcataaagaagttctaaaatcgcttggtttctttgcccaagcggtgtactgacatcagaaacagtaaaaagctctttcagttcctcttcatacaaaaatgaaggaattcgcttatcctgctttggtaagctaacgagtaaaaaaggattttctttcacaagctgttctcttaatagaaatttataaaagctgcgaagcgcagagactttcttactaatcgttcttcttgtcaggcctttttcataagcttctgttaaataaattctcgtatcttgataggatacctcttcaaaaccgtctattccttgaacgttcataaatctgacaaactcttcaatcgcttctgtatatcctgagatggttaaaacagaatagtttttttcaatttgcagatattcaatgaataagtggacaagacgctgtttattcgtcatttttacacctctttaaggcttttaaatggtatcacatatcttgctttccttgcaatgttttactacagagatttcgaaatagtttgaatagtttcgattgcgcgcttagcgtactctgcataacgctcttgtttgtttttaatgcgaacaccaagatctttcaacaagccaaaattcgcattcattggctggaagcttttcttgtttgtcgatgtgatgtaataagccatgctgccaatcgctgtttcctccggaagagtcacaagctcttctcctttgacaaaacgagcggcgtttataccagcgactagtccggaagctgcggactcgacatagccttcaacgcctgtcatttgtccggcaaagaatagatcttctctatttttaaactgatacgttggttttaaaagactcggtgagttaatgaatgtattgcggtgcatcacgccataacgaacaatctctgcttcttcaagacctggaatcaagcggaatacttctttttggtcgccccacttcagatgtgtctggaagccgacgatgttatataaagtacctgctgcatcatcctgtcttaattgaacaacagcgtaaggtctttttcctgttttcggatcttcaagtcctactggcttcatcggaccaaacaacatcgttttctttcctcttttcgccatgacttcaattggcatacagccttcaaagaagatttctttttcgaactcttttaatggaactgtttcagcagaaataagcgcctcataaaaacgatcgaattcttcttctgtcattggacagtttaaataagcggcttctcctttgtcataacgtgatttcaagtacaccttatccatatcaatgctatctttctctaggataggtgccgctgcatcgtagaagtatagatactcttctccagttaacgattttaattcttttgaaagtgcttcagaagtaagtgggcctgtcgcaataattgttgggccttctggaatgctttgtacttcttcttgaaagactgtcacattcgggtgattttttactcgatcagtaacgtttgctgcaaattcatgacgatctactgcaagcgctccgccagcaggaactgagctttcatctgcggctgcgataatcgctgaatctaaatgacgcatttcttcctttaatacaccgaccgcatttgtcaaagcgttggcacgcagtgaattgctgcatacaagctctgcaaatttatctgtgtggtgagctggcgtttgtttgacaggtctcatttcatataagttgactttaattccgcgtttagcaatttgccatgctgcttcacttccagctaaacctgctccgatcacatttacaaattgactcattgtacaactctcctatttcgtaagttctgtttgatgacataaaaaagcaggtgaacaaggttgctcaccgctatttttgttgttcctctttataatcacagttcacacattgaacttgcatgccttttttcagctttttctctacaagcatattttcgcattttggacactttctttcaatcggtttgtcccaagagacgaattcgcactctggaaaacgatcacagccataaaaaatgcggcgcttcttagattttcgttcaacaatgtttccttcatgacatgttgggcatttcacaccgatgtctttcacaattggttttgtgttacgacagtcaggaaagttagagcaagccatgaacttaccgtatcgacccattttgtacaccattggatgtccacactcttcacagtcaaccccggcgtattcaggctcaatctcaacttcttgcatttctgcttccgctttttctacccgttttgcaaagtcttgatagaagctgtcgataatgcgaacccattcgatcgtaccttcttcaacgctatcaagttctttttccattttcgctgtgaattccacgttaatgatctcagggaagaattcaatgattaagttgagaacaatttccccaagctctgttgggataaaccgtttattatcaagtgcgacatagccgcgcttttgaatcgtgtctaatgttggtgcatacgtagacggacggcctattcccagctcttcaagcgttttgacaagtcttgcctcagtatagcgtggaggcggctgcgtgaaatgctgttcaggttcgatatcttttgaaagaaccgtatcaccttctttaagatcaggcagcattttgtccttttcttctagctggtcgtctttcccttctacatataccttcatgaatccagggaatttcactttgcttccgttagcacggaatgtaagcccgttattatcaaggtccacactcattgtatcaagaacagccggcgccatttggcttgcgacgaatcgttcccaaatcaatttatacagacgaagctgatctcggcttaagacatgtttgacatctgctggttttctcagcgtagaagtcggcctaatggcttcgtgagcatcttgtgcattttcattctttttagcggttcgttttgttgtatttaagaaattcttaccgtacgtctgatcaatgaaagcagatacttcttcaattgccgtattggaaatacgagttgagtctgttctcatgtatgtaatgagtccgactgtaccttctttaccaagatcgattccttcatataattgctgtgcaatcatcatcgtctttttcgcacggaagtttaattttcttgcagcctcctgctgtaaagtagatgttgtaaacggaacagctgggtttcgtttacgctcttttttcgtcactttctctacagagaatttgctcccttttagtttcgaaaggatttcttttacatcttcttttgttttcagtggatgctttttgccattgacgccaaagaagctcgcttcgaagctttcttttccttttaggaatgtaccgtcaattgtccagtattcttctggtttaaattcattgatttcattctcgcgatcaatgatcaggcggagtgcaactgattgaacacgaccggcacttaagccctttttcactttcttccataaaatcggactaattttatacccaacgagacgatctaagatccgtcttgcctgctgtgcatcaactaaatccatattgatcatacgtggatgcttaaaggaatctttaatagcatcttttgtaatctcgttaaagacaactcggcagtcagacgagaggtcaaggtcaaggctatgcgctaaatgccaagcaatcgcttctccctctctatcggggtcagctgcgagatagactttctttgcttttttcgcagcggtttttaattcttttaatacggggcctttcccgcgaatcgtaatatacctcggttcgaagtcatgctcagtgtcaacaccaagctgacttttcggtaaatctcttatgtgtcccattgaagcctttactttatactttttacctaaataacgctcaatcgttttcgccttggctggcgactcaacgatgactaaataatcagccatactcaaaatcccccttaagaggtgttctctctttatacatttcacaattcatatttatgttaattgcacctatctaacaggcaatcatgaaaaattctttatgatgaacatcattataaacacgaaaaacaaagtgtaaacttaaatcctcactattattaaatattcctatgtcttttgtcaaacgatatttttatgagagttcagtatattgaacaccgcggaaggagaattcctctaaaatatccttcgttgaatgaacaagctttgctccctgctgtataagtttggctggacctgtggaattaggatcaaagattgatcctgcaaccgcaaatacctctttgccttgctcaagtgcttgatacgcggtaatgagtgaaccgctcttttctttgcactgaatcacgatggttccacttgttagcgcactaattaatcgattcctcaaagggaaatgccacttttctggtttgacataaggcggatgctcagacaaaagcaaatgatgctcgcccatgtattcagccatttgcacatgttcctttgggtataagtgctgaaatccgcctgctataataccaatcgttttccctttattcctaatgcactctttgtgtgcgattccatcaatgccttttgctaagccactgacaatcgtccaatcttcctttacaagctcaccaacaattttcttcacacatgcttctccataagacgatggaactcgtgtgcctactacacctaaacttttttcttcatttaaatatgatatgtttccttttaggaataacacagggggaggatcataaatatgttttagtgtgctgggatataagggtgatgtgatgggaatcatgtgaatgttttgctttaaataggcttgaacgatgtgttgaaaaatggggaattctttttcttcggcttgttttaagcgggtaaagtcgattgtttgtaatgatcgatcctgtttgaaatgatgtgtttcttcatttatatatagctcaggatcgactttccaccattttgttaacaaagagggtgagatgaggccttttaagcggtgaaaaatcattctttcggacacgttgtacatacaattcctcctgtttaagatagaaagaagaagacttgtcaaagaacaagtcttcttgtgtcattaatgcgttttacaagcttcaaaaagattcttctcttttagtactttaatcaatgtttctcccatgacagatggtgtctctgccacttcaattccacattcacgcattgtttttactttttcatcagctgttcctttaccaccagaaataatggcaccagcatgtcccatgcgttttcctggaggcgccgttttaccgccaataaagccaacaactggctttgtcatatttgcttttacccattcagctgcttcttcttcagccgtaccgccgatttcaccgatcataatgacagcatgtgtatcagggtcttcattgaatgcttttaatacatcaataaagtttgtcccattgacagggtctccgccgattcctacagctgtcgattgaccaacgccagcttctgaaagctgatgtaccgcttcatatgtaagcgttccagaacgagaaacaacacccacatgaccttttttatgaatgtagcctggcatgatcccaatcttacattcttcaggtgtaatgacacctggacagttagggccaacaagtcttgtctttttcccttccatataccgttttactttgaccatgtcaagtactggaatatgttcagtaatacaaatgactagatcgacttctgcatcaacagcctctaaaatggcatctgctgcaaatggtgctggtacatagataacagaagcatttgctccagttgtttgaacagcttcagatactgtattaaatacaggaactccttctacttcagttccaccttttccaggtgtgacaccgccaacaatatttgttccgtactcaatcatttgttttgtatggaacaatgcggttgaaccggtaatcccctgaacaattactctcgtatttttattaataaatacactcatttaggttccctgcctttctgctctacttgactaaagatacaatcttttctgccccgtcagccatagactcagcagaagtgatatttaagcctgaatcgctcaggattttcttccctaattcaacgtttgttccttcaagacgtacaacgagtggtaatgttaagccaacttgtttcgttgcttcaacgacaccttctgcaatgacatcacatttcatgatgccgccaaaaatgttcacgaaaatcccttttacattttgatcagataagatgattttaaatgcttccgttactttttcagctgttgcaccgccgccaacatccaggaagtttgcagggtccccgccgtaatgcttgatgatatccattgtagacatcgcaagacctgcaccattgaccatacagccaatatttccatctagagaaatgtagctcagatcatatttagatgcttcaatttcttttggatcctcttcatcaaggtcacggtattctaatatatctttttgtctatataaggcattgctatcaaagtttaatttcgcatcaagcgccatgacttttccatcgcctgttacaacaagtggattaatctcagcaattgaacaatctttttcaatgaacgcattgtaaagacttgtcataaacttaacagcttggccaactaattttgttggaatattaattttaaacgctacttctctcgcctgataaccttgcaatccaatcgctgggtcgatgaccactttgacgattttttctggcgttttttctgctacttcttcaatttcagtaccgccttcttcagaagccatcaacacaattcttgatgtcgctctgtccaaaacaagtccaacgtagtactccttttgaatatcgcagccttcttcaataagtaagcgttttatttcgcgcccctctggcccagtttgatgtgtgacaagtgttttgccgagcaattcctctgcaaaccccttcacttcatcttttgtttttgcaatttttaccccgcctgctttaccacggccgcctgcatgaatctgtgcttttacgacatatacagagctttctagctcttctgatgctttcactgcttcatcaggtgtaaatgctactttaccatttggaactgaaaccccatattttcttaggatttcttttccttggtactcatggatattcatttcccatcctcccaacatatgtagaaacaaaaaatataaaatagactgcgctttcattttaaagaataaaaaagagaatgtctagggttctatgtaaaatcgtaaaatccttctaaacattcaaacttttattttattaaaaatataaatttttcatccaaatcacttattttaccttattttttcattttttgatctaacctatagataaacgaaaatatttctgctacagtatcgtataacgcttcagggatctcctcatccagtgttaaatggcgcatgagttcgactaaattacggtcttcttggataggaactcccgacttttttgcttcttcaataatatggtctgccacatagccgctccctgtcgcgaccacttttggcgccttttgtttttcttcatcataatgtagagcgaccgcccttctaagcggttttgaatccttcatactcgtaagtccagccccttctcgctgattttatgaaagtgttcatctagaaagtgagacggatctactggctcttgtctcttctttgctgtaattcccgtgaggctgtatcctaatgcatttaaattctcccgaacagctggaatcatcggattaatggttccttgaagttcatgaccggtttcaactgtaattgacatgaccttttgctgaatcgtacagtcgattaatgtttcttcgaggttttccatgtttaagtaaaacataaggcgacactgagaaatatcaatagagccatcttttttcttatgtccttttagaataaaggttaaatcttgaacactatgttttgaaaagagcggataagagaccatcatttggctgatagtttggttctcctgctgcacaaataactgcccgttcaatctatgaaacaattgatcgacttctttttttacgggctctggtaaatcagactgtctcacatcatttaagacgagctttaattggtgaagctcctgactttttgcatcttggttgcctttttcgagtagtttcagcataccgatttcgtcacgtacacctattgcctttttcatcgtcatgagtaaatcgagcacgtcggttttattgcttaatgcgggttctgtctgttgcacgacctgagccaatacttttgcttctgtttttgacaagaacggaaattctttttgaagcacagatgcttttgcgtcaggctgagatccagcctgctgaagtccttgcagcaatgacgtaagctgttttaagctaggctcttgctgcccatctgcaccttgttttatcaaacttgttagtatccgctcgatttgctgaggcgggatttgcagctcttttggacttgttgattgctgcacgttagattgaagaacttgggtcgtctgacgctcttgagctattggattctgactattttcttttggttgagacagattggactgaggcgttacaggtagatttcctccttgtttcgccgtcccttctctcgctgctagaaggaccgataagagcttttctgcatggacagtcgtctcagcacctatgactgatcgaacggcttgtgtaagggcctgtgtggcgtctgagtgcttcgggagctgtgttaagcgttctagcagtgctgtcatatcttgatgaagagcagaggatgatttcacggctaaaattgattgaaggactccttcttggatcggcaagtctttctttaaagcaaataggagtgactggagaccttttttcacatcagctccttgaagctgttcgatccacttcactgccgtttttaactctgcttcattgatgacggatttttcttttaaaaaagcagtagctgttaggatgttttctagtccgtttttcagagagagaccttctaatagtttggcagctgcatcctttaatgttttagggtcttgttcaaattgctggactggccttagtttattgaggctgcctccaccctcttgttcaaattggaaccaataaaatgcgtctgctttgagctgagccgctagctgcgcttttatttttgttgagcctatttgaacaagggctgtatcatctccgagcattttcagtactttaccaagaatcagtcgatgcacattttcctttccttcggtgtttaatggcacagattctgccgtattcagccggctattcagtgctgtatgtatgtcctcaactcttgtcatcacaggcagcctccttaggtcaaaaatttatgatataacggatttcactggtgcaaatgataatcgatggattggggtagctccatgtgtttgaatggcagccaaatgctcttttgttccgtaccctttatgtttttcaaattgatactcagggtacttacgcccgtattcttccatcatctgatctcttgtcacctttgcaatacatgcacctgctgcgatagacgcactttttgcatctcctttgatgatattctcctgttgaataggaagcgggagcgtcatggcatctatgagtagataatcgggtgtatgagttaacttctccaccgctctcaccatcgccagtcttgatgcctcgtaaatattgatttcatcaatcgtagctgcatccacaatgccgattccgatatcaagtgcttctttttggattaggtcataatatgccaatctttttttctcagataattgctttgagtcgtttaaaccgagcaggactgtatcttcctttaatatgacagctgctgcgacaacggggcctgcaagtggacctcttcctgcttcatctattccagcaatacatgtgtatccctgcgccttcgcactgttttcaaattgcagcatctcattccatgctgcttgaagttgctgctgcttttctctctctttgcgccacttctctatcagtttttggacactttttctcgtatcatcttttacaagttcatgaatgtatgactcgtcttgcgaatgcttttctatcagttcttttatttgtttcactgtgtacatcagcttttcgtcagcctccttctttatatcggcagttttccgcaaaaaataaagacccgcatgagctgcgtgtcttttagctttcaggcttctcgaaagtgaggggaccaaatttttctgttcgaatatcccgaataatgatttcggtggttttgtcgtaattaataaatccaccgctcatgagacagccgcgctttgtacctattgcatcaaacagctcagccgtatcttcagggatctccgttaggtcatagcgtttttttaatcgctctggatagttttcttctagaaagcgaagtccatatacagcgacatcctgtaagttgatgatagaatctttgatcgctccagttaccgctagcctgagtcctactttctcatcttcaaacttcggccagaggattccaggtgtatcgagaagttccaattctttccctaccttcacccattgctgtgaggtggtaataccaggacggtctcctgttttggcaatgttctttttcgctaaacgattgattaaggtcgatttcccgacgtttggaattccgataatgagcgcccggattgcacgtggtttgacaccttttgctttcatgcggtcgaatttttcttttaagatttcctttgaagttgtgatgatctgatttaacccttgtccatcgacagagttaatagcaagtgaccgaacgccttgctgctcaaagtgcgcctgccactcctttgtcacacgaggatccgctttatctgctttgtttaatagcatgattttgggtttattctgaaggatttcttcgatcattgggtttctagaggacatcggaattctagcatcagttaattcaaatacgatgtcgatgagctttaatttttctgtgacttcacgtcttgcttttgccatatggcctggaaaccattgaatcgtcatatgtgcaccttctcttctatctattatctctatacattgtacaaaaaaagagcctgttacaggtaacaagctctttcctttgatatcattatcgtctgatttctttgatacgagccgctttaccgcgaagttcacgtaggtagtaaagtttcgcacgacgtaccttaccgtgacgtacaacttcgatgttagcgatttttggtgtgtgtacagggaatgtacgctcaacgcctacaccgtaagaaatcttacgaactgtgaaagtttcgctgattccaccaccacgacgcttaattacaacaccttcaaagatctggatacgctcacgagtaccctcgaccactttaacgtgtacacgtaaagtgtcaccaggacggaacgcaggaagatcagtgcgtaattgttcttttgtgatttcttcaatcaaatgttgcatcgttttcaactccttccaacagatgctcatgtcctctttcttcattgcagcggaacatcgttttcaaacttgaatcggcaagccgtccaagtcacaagtagtatcataccatacctctatgcagtgtgcaatacaatctagtcattatgaagctgccaaagccatcttttttcttcttctgttaacgttttgcaagaatcgatcaaatctggccttcttgtataggttcgcttcaaagattctttgcgccgccactcttctattttggcatgatttccagagaggagcacatccggcacttttagtcctttataatcggctggccttgtatagtgaggatgctctagcaaacctgtactaaatgaatcttcaatgtgagacgcttcttttccaagcacatgaggcaaaagcctgaccacactgtctgcaatcatcatcgctggcagctctccgcctgtgagaacgaaatctccgattgagatttcatctgtgacaagatgctccctgatgcgctcatcgtagccttcataatggccgcaaatgaacataaggtgttcttcttttgcaagttcctcggccttcttttgcgtatatctttccccttgaggacagacaagaatgattcggggcttcttgcttgctttcttcgtcaaatcttctaccgcatcgaatacgggctgtgctttcagtaccataccagcaccgccgccatatgggtaatcatctactgttttatgcttatgatccgaatactctctaaaattgacaacattgaatgagacagcttctttctcctgtgctttttttaagatcgatgagtggagcacaccttcgaacatttcaggaaaaagtgttaagaagtcgattttcattcgtcaataagtccttccatcacttcaatgtgtatggttttggatgagatatcgatctttttgacgacagatgggatataaggaatcaaggcatcttttttgccttttcttccgaccacccagacatcatttgcccctggtgttaaaatctctttgatttggccgacaagctgatcctcttcatcgtatacttcacagccaatgatttggtggaaataaaattctccttcatctaaagagccgagatgttctttttctacttttaagattgattctttcaatagctctgcttcatttaatgagctaatttcttcaaatgtaagcaaatcaaactgtttatgctgccggtgtgatgcgacagtgacttttagcggctctccttgaccttgcttaaaaatatagaggacgcttccttttttataacgctcttctgggaaatctgtctttgacacgacgcgcacttctccgcgcactccgtgtgtattgacaatctttccaacattcaaccattcctgttccatgttctcaatcacccctgacgtatttccacaatggtgccgtctttcacgacgatgacattatcttgcatcttgtcatcccatttatcacctattttcacttcaaccagcgcatccacttctgtctctttcatttcacttccaagcggcaaaatatgtagctgctctacttgaaagtcaatttgctggattttctcttgccgtttatcgatggctttttgaaattgagggatggcttcttgctgatgtggttctttttcatgttttttcagttgaaaatatagttgattgcattcacgttctagtctttcttttttctccaaaaaagtcgttaacagtttgtccttactgctttcagttaatacttgcatgacggtgacatgttgaatgatctgcatcttcctttttgtccccctatccgaaggcatttgtcctctacagtataacgaaaaatagatttaaacgtgtaaaaaaaggggaggtcctaagccctctccctttttagtcagcaatctcaagttgaactttcttagaagactctgcacttgctgcaaacatgactgttcgtatcgctttcgctgtacgtccctgctttccgatcacctttccggtatcttcagcattgacagacagtgtgtaaatcacttgctcatctttttctaatgaagatacgtgaatatcttcagggaaatcaacaagtggctcgacgatggacacaatcaattcttccaaggacagctcattcattatttgctgtttttcgcattatgaaatttttcaagaattccttggcttgagaaaaggttgcgaactgtatcagatggtttcgcaccattttgaagccatttaagagctaattcttcgttgattttcacctcagctggtgataaaactggattgtatgttccaactgtttcgatgaaacgaccgtcacgtggtgaacgagaatctgctacaacaatacgatagaaaggagatctttttgatcccatacgttttaaacgaatttttactgccattttactagcacctccgaaaatatttcaacaagatagtatattaacaatgataaaagggtttgtaaagtgttttttcttaacaacagttttatcatgtataaccaattacataaatggtaatttaaagccttttttcttccctttggacatgttggtcatttgcttcatcatctttttcatttcgtcaaattgctttaaaaggcgattgacttcctggacagatgttccgcttccttttgcaatccgttttcttcggcttgcattgatgacctctggctgttctttttcctcggtcgtcattgatttaatgatcgcttcgatgtgattgagctgcttttcgtctacttgaacgtttttgagccctttcattttaccggcacccggcatcatttggatcaattcatcaagtggacccatgttacgaacttggccaagctgctcgaggaaatcatcgagtgtaaagctcatggtccgcattttttgttcaagctctttcgctttatcttggtccacgtttgcctgtgctttttcaatcagtgtaagcacatctcccatgccaagaattcttgatgccatccgttctgggtggaatggttcaatcgcgtcaagcttttcacctagcgcggcgaatttaatcggcgtattggtcacagctcgaatggaaagtgctgctccgcctcgtgtatccccgtctagtttcgttagaacgacacctgttaaaccaagctgttcattaaagcttttcgctacattaacagcatcttgacctgtcattgagtcaacaacaagaaaaatttcttctggactcgctacttcttttactttctgaagttcatccatcaattcttcatcaatatgaaggcgtcctgctgtatctaaaatgacataatcatggtgttcttctttcgctttttcgattgcctgtttggcaatctcgacaggactgacttgatcacctaatgaaaacacaggcatatcaagctgtttccctagcgtttgaagctgctggatcgctgctggtctgtaaatatctgcagccaccatcatcggcttgcgattatgttttttgcgaagtaaattggcaagcttcccagttgtggtggttttaccagccccttgaagaccaaccatcataatgaccgtcggagattttttcgctacagcgattttactctcttctccgcccattaattcagtgagttcttcttttacaactttaatgacctgttgtccaggggtaaggcttttcatgacctcttgtccaactgcccgctcacttacttttttcacaaagtctttgactactttaaaattgacgtcagcttcaagaagggcaaggcgtacctcgcgcatcatttcttttacatcttgttctgacacttttcctttgccgcggatttttgaaatcgtctgctgcagtcggtcggctaatccttcaaatgccatactgtgccgcctcctaatctaatttctcaagcgattcaattaaagcttctgcttcttccgtctgtgcggaatctgctacgagctctctcatttttttgagaagttctttacgctctttaaatttcttaaacaagagcagcttttcttcatattgttcaagcatcgcttcagtccgtttaatattatcataaacagcctgtcttgatacttcatattcatccgcaatttcaccgagggaaaaatcgtctaggtagtaaagcgacatgtagctcttttgctttgcggttaacaacgattgatagaagtcaaacaagtagttcattctcgttgttttttcaagcgtcatgggctctctcccctttgttaagttcattccctttacatcaactaagtttacacggttctctactgtgtgtcaagtttttatcttgtcacttcatgaagcggcgtataaataaaaatgccagcagtttttgccggcatttttgttagtcttcttgatcaatcacgtctgagaatagtccatacacatacgattctgcatcgaattcttgcagatcgtctaccttttcacctaaaccgacgagcttcacgggaatgttcagctcatttcgaattgcaaggacaatcccgccttttgcagtcccatcaagctttgttaaagcaattcctgtcacattcgtcgctttagaaaattccttcgcttgagccatcgcattttgacccgttgttgcatcaagagcgagcagcacttcatgcggtgcatctggaacctcacgttcaatgactctcttgaccttctctagctctttcatcaagttgactttgttttgcagtcttcctgctgtatcacagataaggacatccgcatttttcgcttttgctgattgaacggcatcatagatgaccgctgctgggtcagagccagccgtttgtttaacaacagggacacctgaccgctctccccatacttcaagctgctcaatcgcaccggcacggaatgtatcacctgctgccaaaataacagatttcccttcatttttcagcttatttgcaagtttgccgatcgtcgttgttttcccaacgccattgacacctacaaataaaataatatttaatcgcccgtcttcaatattcagcgcagagatttgttcctctccgctattgtagatttcaaccagtttttcagaaatgaccgattgtacttcacttgggtcttgaatgtttcttaatttcacttcttttttcagctcatcgatcagttccatcactgttgtaaaaccgacatccgcgccgattaaaacctcttctaattcttcaaaaaagtcttcatcgactttacggtagcgagaaattagttcgtttactcttccttgaaaggagtttctcgttttttcaagtccatctttaaacttttctgatactgaatcggtttgctgcgtaaatttttcttttaacttcttaaaaaagctcatttggttcaaaaacctcctttaattactggacaagctctttcgtttcttctagtttgacggatacaagtttagaaactcctgactcctgcatcgtaacaccgtaaagcacatctgcttcttccattgttcctttgcggtgcgtaatgacaatgaactgcgtttcctcgctgtatttctttaaatattgcgcaaagcggaaaacattggcttcatcaagcgccgcttctacctcatctaacacgcagaatggaacaggtctgacttttaaaatagagaatagtaaggcgatcgctgtcaatgctctctctccgcctgaaagcaggcttaagttttgcagctttttccctggcggctgcgcgacaatttcaacgccagagtttagtaaatcatttggatctgttagcttcaggtctgctcttccgccgccaaataacgcttggaaaactgattcaaaatgcccgcgaatttgcgagaatgtttcagagaagcgctttgtcatctcttgatccatttcttcaatcacttggaataatgtatttttcgcttctgtcagatcatttcgctgttctgttaagaaaaggtagcgttcatttactcgttcatactcatcaatgctgcctaaattgactgttcctagctcttcgatggctaatttgatcagcttcactcgttttcttgcttcatctggcgatagcgttagatgatacatctcttttgccccttcaaatgaaagagcatactcttcgttcaaataagcgatgaggttgtcgagctcaacctccatacggccaagcttaatttcttcatcttttaaacttgtggtgagctgtttataaaggcgtttttgttctttcagttcacgttcagcaaattctaacgtttcagaaagagcaagacgctgtttacgccgctctgaaatgagtgcggttgttttgtttttgttttccagcttctctttcgccgcttcttccaactgttctgctccgcttgagctagacgtcatttcacttgttaaaagtgacagatcttctttggtttccgtcagcgtttgttcagcctcttctaattcggctattaagctcgaaagcttttcttgttcgttcgctaaggactgctcttttttggcaagtgagattttcagctcagttaattcggcagaaatagtttctttcgttgagctttgggtctgcttacgctttgttaatgtattgatctcttgatcaagggtggtcaatttctcccctatagaaacttcaagagctgcctgctctttgtccttatctgtcagttcagtagaacgcagctgcaattcttctttttcttggtcatagagttcaaggtgagcattaatatttttttctgctacttgcagttcgtacagcttccctttgagctcttgctgctgttctcgaagcgtttctccccgctgacgcagttcgtttaattggctttcgtttgctgcaatcaattgcttcgtttcttttgtttccttttcaaggatcgttgttttttcttccatttcaacgagctgctttgttaatgtttcaatctcacggtttcttgaaagaagggagttgttctttttcttcacaccaccaccggtcattgaaccgccggggttcacaacatctccatcaagggtcacgatgcgataacgatgaccaagcatttttgccagttcattggcaccttttaagtctctaacgattagaaccgttccaagcaagttctgtatgaccttttgatacttttcatcaaaggaaacaagttgactcgctacaccgataaatgcagcatgctgctcagctgtttggacgtctctatgctgaatggttctttctttgatcacattcattggcaggaaggttgctcttccaaaggagtgctgctttaagtatgcaattgcttgtcgcgctgcggattcattttctgtaacgacgtgctgcgttgctgcacctaacgcgatttcaatcgctgtctcatgctgctgatctgtttgaatcagctctgcaatggcaccgtgaataccgcctaaccgttcttttgcctttaagacctcttttactccttggaaaaagcctgagaagtcttcctgcatggattctagcatttctttttttgattttgcctgctgcacatattgataggcttggtaaagagccgtttcttttttctcgtattgacgtttcatttgctcaagcttttgctctgcttccctaaaccgcttgacttgagccaaaatgtcttcttctagggctgaaagctgctgctcagcctctgttttcttctctttgacagatacacgctcttcaatgtgtttttggttgttttgcgtgagccgatccagctgcatgaccgcttggcgctgctgttcttctaataatttgcgttcattgcggatggaagcctgttcattgagcagatcaaaataatcgctttttagctgttcaatttgaccttccacatcttcactatgaagcgacagttgatgctgctttgttttcacttcatcttttatctgctgcacttctttttgaaggctgtcccgcgtgattttctgctgctgaatcttttcggttagctgcgcctgcttttcagttaagcgaatgagtgtttcttctagctgtccctggtttgcggctgcatttttcttccgttcttttagtacttctttttttccttcaagcttttctaattcctcacttgtgaaaagaagaacttcttgcagatcattaattgattcgtcaagtgcttgaatgcggtctcttgactcttcaattttagcttcttttgcttgaatatctgtggattgcttcatttcatcttgtttgaagcgctcgacagcttcaccaagtgttgtccatttttcatgaagtgcttcaatgtcatgaacagttaaggcgatttcgacattttcaagctcttcttttttttgcaaatagtcctttgcaatagacgcctgcattcttaaaggttctacttgatcttctagttcatgcagaatatcttctactcggtttaagttgtcctgcgtttcaaacagtttattctcggcttttttctttcttgttttatatttcaaaacaccagccgcttcttcaaagatgcttcttctctcttctgccttactagataaaatttcttctaccttcccttggctgatgattgaaaaagcttccttcccaagacctgaatccatgaaaagatcaataatatcctttaagcggacagattgattgtttatgagaaattcactttctcctgaacgatagactcttcttgtcacactgacttcgtgaaaatcgatcggtaaaaagtgatcttcgttatctaatgttaaagtcacttctgctaaattgactctttttcttgagtcgcttcctgcaaaaatgatgtcttccatttttcctccgcggaggcttttcgctgattgttctccaagtacccagcggatggcatcggtaatattacttttgccgcttccgtttggtccaacaacagcagtgacccctttgacaaagtccacggtcactcgctgtgcaaacgatttgaatcctatcacgtctaaacgtttgaggaacatgagagtgatcctccttatgtatttaaagtactatcatcttaccatatgaagtgaaaaaagatgatggaaaacagagtgaaatccccctgaatgacgagggggattttattggttcatatgatgtttctgcaatttagcaagtgcttcctgtgcagcgtgctgttctgcttcttttttactgcggccatttccaattccaagcacatctccgcgaagggagacatttgcttcaaattcccggttgtgtgctggtcctttttcatgcaagatacggtattccagtacaccttttccatcgcgctgaacgaattcttgcagctggcttttaaagtccatgacatgcgagaacgctccatcattaattttcggataaacataggcttctaagaatcgttctaccggctcaagcccttgatccaaatagagtgctccgataaacgcctcgaatacgtccgctaagagcgctgggcgttttctgccgcctgtcatttcttcgccttttcctaaaagaacaaggtctccgaaggacagctcatgtgccagagacacaagtgacggttcacatacgattgctgctcttagtttcgttaaatcgccttcactcatcgcaggatatttcgcaaataagaattgagagatggtcaattctaaaacagcatctcctagaaattcaagtctttcattatcctcgtatggctttttccggtgttcattcacataagaggaatgcgtaaatgcttgatatagaagtttttcattttgaaaatgtacagaaatgcgctgctggaattctctaaattgctctagttttttgctctgtttctgtttgtctttatattgttttggcatagcaacctccaggtaggcttaatcgcctttaaggatactgattatatggagtctctctttctacatgcaaggaaacattgctccttagcatctgaaaaaggctgacaattgatcagctgaatatgttgaaactaacataaattttgaaagtcccgtcatgaaaatagacgggactttgttacgcttattgctggctatttatgtagttcacagcgtcaccgactgttgcaattttctcagcatcttcgtcagaaatttccatatcgaactcatcttcaagttccataactagctcaactacatcaagggaatcagcgcctaaatcttctttaaatgaagcttccattttcacgtcagcctcatcaacgccaaggcggtctacaataatttttgatacacgctctaatacgtctgccattgcctttcacctcccctcaaagtattatagttgattcgtttttaaaaaactagagaaaacctaatgaaattttgatatttcttaagacatgaccattccgccatctacttggatggtttggcctgtaatataacctgctccttctgaagctaaaaagacaacaacgttgctaatatcttcaggtgcaccaaagcgtgcaagcgggatctgcttgagcatttcagtctgtacattctcatcaagcttgtctgtcatatctgttgaaataaagcctggtgctactgcattgactgtaatatgacgagttgccagctcttttgctgttgttttcgttaacccgataacaccagcttttgctgcaacatagtttgcttgtccagggtttccacatacgccaactactgaagccaaattgatgattcttccgctgcgctgtttcatcatttgacgtgtcacggcttttgtacagttaaagacaccttttaagtttatgttaatgacgtcatcccattcattttctttcattctcataagcaggttgtcctttgtgatccctgcattattgacaaggatgtcaattgaaccaaatgtgtcaatcgcttgcttcatgagcgcttgtacttcttcagcatttgacacatcagctttaacggcaaatgcctgctggccaagtgctttgatttcgtctacgacttcatttgcttttgcttcgtttccagaatagttgacgacaacatttgcaccattctttgccaaatcgatcgcgatagaacggccaatcccgcgtgatgcacctgttacaacggctgttttatttgtaagcatcaagaatcctccttcaatgtttcaatggctgcttcaattgtttcctgatctgaaactgaaatggttgtcaggcggcggttaacctttttcacaagacctgaaagcactttgcctggaccaatttcaataaacgttgtcacgcctaaatcaatcagacgttctacgctttcttcaaatcgtacaggagaatacaattgttcaatgagttttgtttcaatagcatcacgagatgtaacgatgtctgctgtgacatttgagatcactggtgttttggcatctctaatgtctagctttgacagaacatctgtgaatttttcagcggctggtttcattaaggcagaatggaaaggtccactcacttcaagggcaatcgcacgttttgctcctttttctttcgctttctctgaagcgagttcgacaccttttgctgtaccagagatcacgatttgaccaggacagtttaagttagcgagttctacaaggtgaccgctctctgtcacttcttttgtcacttctaaaagcgcagcttgatctaagccaaggatcgctgccatagcgccttctcctgctggaacagcttcattcattaattcgccgcgctttcttacagcatacacagcatcttgaaatgaaagtgcacctgctgcaacgagggccgtatattcgccaaggctatgtcctgctgcgtaatctgctttgattccactctcttcaaatttctttaagatggcgatacttgtcgttaaaagagctggctgcgcgttataagtgagcgtcagttcttccgcatctccttcaaaaatcattgaagataagtcaaaaccgagggtcttgtctgcttcttcaaatacagatttagatactgcttcttgatcaaataaatctttccccatgccaattttttgagagccttggccagggaataaaaatgcaattttagtcatgatgttttacctccattaagactcgttcgtggtttctttttggacttcttgatgaatgatggctgaaacgtctttttctacgatatcacgtgcctgacgaatggcatgaaaaatggcgttttcatcagaggaaccgtgcgctttaatgacaggtgcctttaaaccaaataaagcggcaccgccatattcggagtaatccattttagacttcatctgcatcaatttcggcttcatcatgccagccgctatttttgctgtgaagctggatgttaaggtttctttcagcattttaaatacagaaagagctgtgccttcaatcgttttgagagcgatatttcctgtgaagccatctgtgacaacgacatcagctacaccttctaataaatcacgagactctacatttcctacaaaattcaagtctgatgcttttaataattcaaaagtttttttcgtgagatcgtttccttttttatcttctgttcctacatttaacaatcctacacgcggattgctctttggaaaaacacgctctgcgtagattgaacccatcatggcatattgcacaaggtgttctggtttggcatcaacgtttgctccgacatctagtaataaaaacccgctgccatcaagtgttggcagtgttggagcaagtgccggtctatcgatgccatcaattcttcctacgataaacagtcctgctgtcatgagtgcgccagtgtttcctgctgaaatacaagcatctgctcgtccttcggatacttcttgcgccattttcaccatagatgaatcctttttacgtctgactgcacgtactggttcatctgtcggttcaatgacttcttttgcatctaaaatcgtaatgcgctcgttatttgttatgtatggtttgattttattttcatcgccgacaagtgtaatctcgatatctgaaaatgccgttaagcttttttgcacaccgtcaattatggctttaggggcatggtctccccccattgcatcgactgcaattctcatattacgtgccaccttttacttttgttttgagcgatacatgacgaagtcacctgagaagacaacttcctcaccaacatagctgtttacttcaactacagttctgcctttttctttatcatgcgaagctactttggcttttgagacgactcgttcgccttgtttaacctgccttgtaaatttaatattcgcttttgccgttaaagccagttcatcgtcaatgaccgctactgcaagcgaatttgcctgggcgaaaagatgatgtcccctggcaatttggtttcggctaaatacatgctcttttctcacttctaaaatggaaatggcttggtcatcaagctctacatcaatcatttctccaattacttcatccagcggaagtgacttcacttcatcctctaatgtcttttcagccacatgcttaattctttcgcgtaattcaggaatcgacagttccaaacgatcaagacgaaccgtttgaatacttacaccgaatttacttgccaattcttcatcagtaatgaacggagtcgagctgatcgtttgctggagaagcttttgacgttcttttttatttagtttcatatgcagacaccatccgtacatttatgactaggtactaatagtagtatataatctcatagatgataaatcaatccttgtttcaaaaagacaagaaaattcctccagcgcttgatcagcttaatttatctccgcccagcaccccgctgtctataagtgtttgccgaagttctttgtattcgggatctgtccaaaatgcatctgattgcacaagttctgccgcatcttttctagcagtttccagtgctctgtagtcatgaaccatatctgctactttaaattcaggcattccgctttgttttttaccgaagaaatcgccaggtcctcttagctctaagtccttttcagacagctcaaagccgtcggttgtttcggacataatcctcatccgctctttcccggtttctgattttggatccgccattaaaatacaaaatgattgatgctctccgcgtccaacccggcctctgagctgatgaagctgagacagtccgaagcggtctgcatcgtaaatgaccatgatggtcgcattcggcacgttgacgccaacttcaacgactgtggttgaaacgagaatttgtacttcatttgctgtaaagtctctcatcacttgatctttttcatcactcgccagtttcccgtgcattaagccgatcgcccacttaccgcggtatgcctctgtcagcatgctatggacatcaatcgcattttgcacatccagcttgtctgattcttctatgagtggacaaataatatatgcctgtcttccttttttcagctctttatccacaaatgcaagaattctctcaagcatgtcatgcttgacccaatatgtttcgatctgtttcctgccggctggtaattcatcaatgacggaaacgtccatttctccaaaaacagtgatggcaagtgtacgcggaataggtgtggcagtcatgaacaagacatctgggtcctgccctttacttcttaattttttccgttgttctacgccaaaccggtgctgctcatctgtaatcacaagaccgagctgctgaaattcgacttcgtcttggatgagtgcatgcgttccaactaatatatcgatctcgccctcttttagacgttccagcaattctctgcggcgctttccttttacagagcttgttagtagggcgatatttagtccccatttttcaaacagctgataaagggaatctgcatgctgctctgccaaaatctctgttgggaccattaatgcaccttgatagccggataaatgagcggcatatagtgcaatagctgcaacagcagttttccctgaacctacatctccttgaagcagacggttcatccggtacggggacgccatatcagacataatttcatcaagcactcttgattgtgcctttgtcagcggaaatggcaggctgtgaacaaactcaaaaacagcctctttggaaaacggatgctggatgcccgatgttttttctcgttctttctttctaatggcctgcatctttagctggaaaataagaaattcttcgtacacaaagcgtcgtcttgcttgcttgagtgattctcttgtttctggcaggtgaatggtttttaatgcttcctgataggacatgagtttataggtagagacaagctgctttgggagtggatcttcagctttatctacataaagtgacaaggcttgtttgacaaaacgcctcatcatcttcacggttacattttcttttactgaataaacaggctctatactgccatcttgctcgtgcgtcccttttttaaattcctgcaccatgatcgattgacggtttttatcccatttgccagtgacggataccgtatcacctaacacaaggcttcgttttaaataagggcgattgaagcaaatggctgtgatgagaaaacgcccgacaagcagcctgaatgtcagcctgcttcgtttttttccataataggtgaggacgggctcactgtgcacttttccttcaactgtgacacgttcgtcatgctttacttcttctaaattacgaagctcatagtcatcatatcgataaggaaagtagccaagtaaatcggctactgtgtggattccaagttcattgagtgttttttcagtttcttctccaatccccttgaggactgagacgttatcttgcagtttctgtatcacgagatgaggtcacacctccgaaaatcttcttttcaagctctcttgctgtcggtgttgcagcaagtccgccttgtgctgtttcgcgaagtgccgttggcatggtttgaccaattttatacatcgcatcaatgacttcatcacatggaatacggcttgtgataccagcaagtgccatatctgctgcgatcatcgcatttgatgcacccatggcgtttcgttttacgcacggtacctcgacaagtccagctactgggtcacaaacaagtccaagcatatttttcagtgtaatcgccattgcttcagcagattgctgaggggtaccgcctgccatttcgacaatggctgctgccgccatccctgaggctgaacctacctcagcctgacagccgcctgctgcaccagagatgctcgcattattggccacaacaaaaccaaatgcgccagaagtgaataggaatctgaccatttgttcctttgttggctttaatgtttgttttactgcaaataacgtacctggcacaacacctgctgagcctgctgtaggcgttgcacagatcgtacccattgcggcattgacttcatttgttgccactgccttactgacagcatctaatatcgtatgaccagacaatgttttgcctgatgcgatatacgcttgaagtttgaccgcatctccgcctgttaaaccggataatgatttcacacctttcagcccgttttctacggcctgctccatcacttctaggtttcggtacatttgggagaaaatatcttcacgtgacttccctgtcacttccatttcttgtgtaatcatgatttctgaaatggaggtattccgttcttctgttagctgcacgagttctttgacgtttttaaacatcatccataacctccttgttgttactctgcaatttgtgtgacttgaataatgtttggcagcgtttcaagctctgttaggacagctgggtcaatattttgatccacttcgatggtcatcagagcctcttgcccgacatctttacgcgccacttccatatgaccgatgttgatggcgaatttcgctaacacgttggcgactgccgcaatcgtaccgtagcgatcgttatgaaccacaagaatggcaggatgatttcctgaaagtctaagctcaaagccattcagttcagtgatttcaattttaccaccgccgatggaaatcccgattaattcaaggcttccgttcgcatctgatatctctacttttgctgtattcggatgcgctggtaccgcatcttcttctttaaattcaatgtcgatccctttgctttttgcaatatcgatcgctgttttgatgcgttcatcaaatgtatcaaaatcaagaacgccgccgataatggcgacatctgtaccatgtcctttatacgtatctttaaaagagccataaaatgaaacgacaattcgtttcggttctcttccaaataagctgcgagccactcttcctattcgagccgcacccgctgtgtgcgaacttgatggaccaatcatgacgggtccaataatatcaaacacacttctaaatttcataggtcttcccctctcataaccactcacatattggtttggttctttctttagactaatggattcaatcatttcccgcaactcatttcaccgttgaatcgttagtaaaaaattgcaaaagaagaagaagggcttgatttgcccttctttcgttattccacagccaaaatatatgaataaagcggctgttttccatcgtggacttcaacttctatatcttcaaatgtttcttcaataaaggcttctaagtcgtccatctcttcagatgatgcatcttctcctttaatgatcgtaacaatctcatcatcttctgtcaccattttggttaaaagttctttggctgcatctaattgatttttcgcagttaaggtgatttttccgttaaagagacccatataatctcctttggcaatgtcgattccatcgatttgggtatctctcaccgcaaaagtaatttgaccgctttttacgtggtcaatcgcttctagcatcgccgcttcgttatcttcgtttgaagctgcttcattgagagaaagaagtgccgacattccttgtggaacggttttcgtcggaataacaacaacctcacgacttgagacagttgccgcctgtttcgctgccatgacaatattagaattattaggtaagataaagacggtttcggcatgtacgctttcaattgctgtgacaatgtcttctgtgctcgggttcatcgtctgtccgccttcaatgacgacggaagcgccgatacttttaaacaagtcagcaattccttctcccattgcgacactgacgactccaaagcgctgtttttcagcagcaggtgcctttggtgcagcggtcgcatgttctttttcttcgttcacaatcgagctatgctgctctctcatgttttcaattttcatgttgatcaggctgccgtagcgctgtgcataggataagacatctccaggctgctctgcatgtatatgaactttcgccagcgtttcatcagataccacaagaagtgaatctccgaattcgcttaagtcttctctgaaagcattctcatcaaaggactgtttgtcttcttcaaatttcaccataaattcagtacaataaccaaattcgatatcttcagtgttcatatggctttgtgcacttttatgatgctctgcactgacaagctcttttaacgttggcaaagaggccgctttcgaaggaagctcctctcctcttaatgaagcaaggaaaccttcatatacgcagagaagtcctttacctccactatcgacaacgcctacttcttttaaaacaggaagtagatctggcgttcgctcaagtgatgctctcgcttcctcaatcgttaactcaagaacacggtcaatgttattttcggttgctgaaacagcaaccgctttctttgctgcatcctttgcaaccgttaagatggtcccttcaatcggcttcatcacggctttatatgctgtatcgacacctgcctgtaaggcaagagcaaattcttttgcatcaatcgtttctttttgttcgatctgtttactgaaacctctaaatagctgtgatagaatgacgcctgagttccctcttgcgcccatcaatagcccttttgacaatgccacgccgaccttcccaatatgatcggtatttgtttcttcaactgcttttgcccctgaagtcattgacaaattcatatttgtccccgtgtctccgtctggcactggaaaaacatttaacgcatccacaatttgtgcgttttgagaaagatggtgagcacctgcaagaatcatttttgcaaatgagcggccatcaagaattctaatagacaatatatttcctccttactacgggttcgtaactcttactccttgtacataaatgttgaccgaatcaacagaaagtccaactgtgtgagaaatcgtatatttgactttcgtttgaacattatgtgcgacttctgatatttttgtaccgtagctgacgatgatgtacatatcaatatgaatgcggtcttctttttgacgcacaagaacaccccggctgaagttctctttgcggagaatatccgtcaagccgtccttgatttgatttttggacgccatcccaacaataccatagcaatcgatcgcagcgcctcctgccaccattgcaatgacttcatttgatatatcaatttgtccgtattttgttctaagttcaatggacacattggttccccctttttgagaaattgccctgagttatcactattttactataagacccttctttttaaaagaaatcattcaatccgacccaatcctacttatactatagccttgattttttatcaagatgtcaaggtatttttcttgaaagaggagtaaacaatccttgcaaaccccttgaagctgtggtaaattattaaagtatcttgaggcatctctaagtacgtatatgaagaatatgatgatgttttcgcagttaggagggaaacaaatggcacgtaaatgcgttattacaggcagaaaaacaaaagctgggaacaatcgttctcacgcaatgaactctacaaaacgtacatggggcgcgaaccttcaaaaagttcgtattctagtggacggtaagcctaaaagagtatatgtatcagctcgagctttgaaatctggtaaagttgagcgtgtataagcaagagtaaacgcctgctacaataaattgtagcaggcgtttttatgtggaaataaaggagattactcattaatctttcttaaatgaaccaagcatcgcacggacaatgccgccaagaaatctaggcagtttgattgtataaaatttcattttgtccccctcctaaaagtaccgcttgcagcacaattgagcttaatcagccatccacattgataggttggtcaatctttgcttcttaccattattaatatgccttcacgaaaagaaaaagtaccatttgagtggatgagttcgttactaatacatagtgtggaaccaggctcaatatgacaatttttcagaggatatttgaaaccttttaatgtcagcttttcaaccggtgttccaaagggcagaaacgacacatattgtttatcctgatcttcttttatttcgtatgtaccaggttcaaacatttgaatgatattttgtttgtctacaagggtgatattctgcttgtgctgaatccctttgtaaagaagatggatatttcctagaaaatgatccgcccttcctcctgtaataccgtagatgtaaatatgtgctgggtgctgactgagtgcccagttcagtgcaagctctaaatcggtttcatccttttcagcttgaaagacattcagggcaggcaatttttctttcagctcccgaagctcttcttctgtcacactgtcaaaatcaccaaaggctttggcaggggtaatgccgtgctctagtaagaagagggttccacggtctacgccaatccagagaacatcctcttgtgatgcttcacgttcaagtggcgggatgtattcaaaaggaccgccggctacgatatgtatgtgcatgatatacgctcctctccatgtaaaaagaaccaaagatcacaatgactttggttccttcctttacgcttctcgaattgcctggatcgctgctgcgcggttgtctttaccgtataccgcagagcccgctacaagtaaattagcgcctgcctctttgcagctttttgcagtctctacattgacaccgccgtctatttctatcagtaaatcggttaagcccttttgttcactcagtgcttttacttcttttactttcgtgaggacagatggaataaatgcctgtcccccgaaaccagggttcactgtcatgaataacacaaggtccacatcttctaatacatgctcaatgtgagaaacgggtgtgtgcggattcaagacgacccctgcttttacaccttgttctttcatatgttgtattgttcgatgtaagtgcggacaagcttccacatgaacagaaataatatcagcgccagcttttgcgaatgcaggaatataccgatctggctgctcaatcattaggtgaacatcaagcggaagacgcgtatgcggtctgatcgcttcgacgacatttggcccaaatgtcatattcggaacaaaatgaccatccatgacatcaatatgaatgtaatctgcaccgccttgttccacatcacggatatctttctccaaattggcaaaatctgctgataaaatggaaggtgcaatataaaccatgatttagtacctcggctttctgtctttgatttctgttaaaaactctaaataatgctgatagcgatactctttgatttgatcatgctcgaccgcatcttttatcgcacacccaggctctttcacgtgcagacagccccgaaatttacaatctgcacttcggtctctaatatctaaaaagtatagacctagatcttctgcttcgatgtcagtaaattcgagcgagctaaagcccggagtatctgcaatgagcccgtctgctgttcgaatgagttcgacatgtcttgtcgtatgctttcctcgtccgagatgggatgagatatgatctgttttcagcgccaattcaggactcatcgcatttaaaagggacgatttgcctacaccagactgaccggcaaatacagtgattttatggtgaaagtgcggagtcagcttctcaatgccgtctccttcaatcgtagaggttaaatgaacctcatagccaatttgccgatagtcgtctgcatatgccatgatcgtttcacgctcttcgtctgttttcaataagtccattttagtgatacagataatcggctcaatatgattggcttcaacaagcactaaaaatctgtctaagagtgaggtgctaaaggttggttctgccgctgagaaaacaagtaccgcttgatcaacgttactgataggcggacgaacaagttcgtttgtccgttctttgacttctaataagtagccttctttatcgttgtctgcttgatacacgacgtaatcgccaacaagaggtgtaattttgttttttcgaaaaatgcctctcgctctgcactgaaccacttttccactctcttttgactcatccagtacatagtagaatccgcttaatgctttaataattttgccctcaggcataaagtccctcctttattcatcatcagggtattcgatcgttttcgagctgacgactttatcatcaaccgtcacttgataatatcctttttgacctggttcaatcttaaatttaatggtccgttcagtcggcgcagtgattttaaagctttcgtatgaatcagagatgctatgctccgcatcatcaatggaaatttggacattcatctcctgtccttccacttctggttcataagggatcgcaatcttttcggtcaccgttttggctggtttttccttcggtccaagagagaatgtaatcttgaccgtgtcacctggtttaacagccgttcctgctcctggttcctgcttcatgacctcgccttttggcacatcatcagaatacgcttctttttcatcaagcttcaagccgttatcctctaaataattcgatgccgcttgcttactatacgtcgttaaatcacgtaatgtaatatcggcaggacctatactgacagtcaacgtgacttcttcatctgctgctacaagttcagtattcgcggaaggactctgttccatgacaatcccagattcggtgtcattgtcattcacttcctccacaacgacctgtttaaacccttttttctctaagatttcttttgctttatcgaccttttcgcctgtcacatcaggtaattcggtcttttccttgccagtactttcgtaaagctgaatctctgttccttctttgacctttgtgccgattttcggatctgttttgacgacgagacctttttcaattttctcatcagcgatctctattgactccgaagcgacggtgaacccagctttctttaaggtatcttctgctttttcaaccgtcatgccagatacatctgtgacttccacatcttttggaaaaagcagccctggaaacacagtgatggctaaaattgtcgcagcagtcaatataaataagatggatgccacaatccatggccattttttccgtttctttttcggcttttgtttctcttttttcttcggtttttgagccggatggacggctgttttttcattgtcttgatcgatttgatgatcttgaataattgggatcgctttcgttgcttcatggtcttcttcaatgacaaagcgtttttcttttaatctggctggatcgaaagcggtttttaaatctttttgcatttcagatgcatcttcatatcgataaaatggatctttggccatcgcctttaaaatgatgttttccacgctttgtggaacagaaggattccaccttctcacagatggcggctctgattgcaaatgcttcagtgcaacactgacagccgattccccttcaaatggcatgcgtcctgagatgagttcatagagcacaatcccaagcgaatagatgtctgactttttcgttgcaagacccccgcgtgcttgttctggagacaagtagtgcacggagcctaggacagaatttgtatgggtaatggtcgctgagctgagtgccatggcaatcccaaaatccgtgactttgatgttccccatattgtctattaatatattgtgaggcttaatgtcacggtggacgagctgtttcgcatgggcttcttccatcgccgcaacgacttgttccatgatgcgaacggcttctttcggatgaagcggaccattggcgtgtatgtattccttcagcgtcattccctcgacatattccatgacaatataataaatgtcatcttcttccccgacatcgtagatgctgacaatattcgaatgatctaagcttgcagctgactgcgcttcccttcggaaacgtctaataaaatcatcatcgctcgcaaagtcaaaccgcaaaattttaatcgctacttcgcgatctaaaatcatatcttccgccaaatagacgtttgccattccgcctccgcctatgacgcgaagaatctgataacggccgctgatcctttttccgatcaacacttgctgtcaccctcctctggctgggaggagatttctaacagtactgctgtaatgttatcttcaccgccgttgtcattcgctgtttgtattaactctgttactttttcctctggtgcggttgtttgcgttaaaatatgaatcaaatgctcttcttctattttattcgatagaccatctgagcaaagcaggatttgatctcctgggtccacttcaaaggtgcgcgcatcaatttgaacacgcttatctgttcctaatgctttcgtgagcacattttttcttggatgatattctgcatccgcttttgaaatttcacctgttttcacaagctcattcacgagtgaatgatcatctgttaattgggtcagcgctccttctcttagcaggtagcagcggctgtctccaatatgcgcaattgtgaccgtttgcaaatgaacgagcgcacatacaatggtcgtccccattccttggcactcctcattgttttgcgcatgttcataaacttggtcattaatgtcactgatttttgagattaaccagctttcttgatcggctggcttttctggaattgaagatatttcttcccagtattcttttaaagaagagactgccatcttgctggcgacatcaccagcaagatgacctcccatgccgtctgctacaacagcgagaagtgaatcttcttttgcttcaaaaatacctgcatcatcttcattatgctgacggacttttcctgtatcggtaagaaaggctgcccttatcaacattcgtcacctcgtctcttcctgacgctccttcgctcttagctgaccgcaagcagcatcaatgtcatggccttgctctcgtctaatcgttacgtttacgccgcgttctttcagcgttttttcaaataggaagatttgttctctaggtgttctcacataatctctctctggtacatagttcaccggaataaggttcacgtggcacttgattccttttaataggtctgccagttcttctgcatggtgaacttgatcatttactccgccaaacaggccgtattcaaagctgacacgtctacccgtcttttgaatgtagtattcgatggcttccattaattttggcagcttatatgccttattgatcggcattaggcggcttctgatctctgtgttcggtgcgtgcaatgacacagcaaagttgatttgcatttgctcatcagcgaattgatagatctttggaatgattccgcttgtcgaaaccgtaatatggcgtgcaccaatatttaagccattatcatggttgatgattttaaggaaggcaagcatttcttcaaagttatcaaacggttcgccaattcccatgatgacaacagagctgactctctcgtctgtttcgtcaagtgcctgctgcacttttaatacttgtgcaacgatttctccggcttcaaggtttcgttttaaaccaccaagtgtagatgcacagaatgtacagccaattcgacagccaacctgtgttgtcacacagacagagtttccatattcgtgacgcataagcactgtttcaattgtataaccatcatgcagttcaaataaaaacttgatcgttccgtcctgagacgtttgtttgatcacggtttttaaagttgtgattgtaaattgatcttttaacttttctcttaattctttggagaggttagacatttcatcaaatgatgtcacacgtttctcataaagccactcaaaaatttgagctgcgcggaaaggtttttcatcttgttcttttaaccattctttcatttcgtgaagctcaaatgaatagatcgacggcatatctgttttcagttcttttcttactttttgttctgtcattttttatcccttctttctcatgctgcaaataaagaaaccatctgttccgaaataatgaggaagaatttgcacacttccgttttgaacaaacggagcaacctgctcaggcagccgttcattaagagatagatcgggttcgaagtcttggtgttcttgtaaaaacgcatgaatcacttgttgattttctgttgggtccattgtacatgtactatatacaagggttccgccaggctttaaaagcggagctgtttcttttaagattgcctgctgaattgcagcaagccttgctgagtcttctggagactttgtatatttcatatctggtttccgtctaatgacgccaaaaccagaacacggcgcatcaatcagaatccggtcaaatgaagcttcgctgtaatcaccctttgctttccttgcatcaagcgcttttgcttcaatctgagtaaggttcagacgttttgcggcttgtttaatgagtttcactttatgttcgtgcaaatcaagtgaaacaatttgtccttcgtcgttcatacgctctgcgatatgtgttgattttccgcctggagccgcacaggcgtcaagcacaatttctcccggctgagggtctagtgctcttgcgacaagcattgagctttcatcttgaatggtcacatagccttcttggaaagaaggggttgaaacgatggaccctttcatcagcttaagtgcatcttcagataagtcaccaagctccgtttcaatcccggcctccagcagctcttgctgcagtgcagcgcggtccgttttcattcgattgacacgaagggtttgctttggcggtactaaatgaatacggcacatgctttctgctgcttcaaatccgtatgactgaacccactcctgcacgagccataatgggtggcttgtctcaatcgaaagccgcttgaccggatctttgatgtcatcaaaagccggaacgccttctctttgcacagaacgaagaacgccgttcacaagtgatgaaatgcccttgtgccctctctttttcgttagctcaactgcttcatggatggctgcacgatctggaatcttttcaaggtagaccatttgataaagagacatccgcaaaagctgcatgacccaaggagccaccttttgcggttttttcacaaatggtgccagcatataatctaatgccagcttgttttgcagagtaccgtacacaagctctgttaagagcggtttgtcctgatctgccaagtctttgtctttcatgactgactgcaaaagcaaattactgtatgcttggttttgttcgagtttgattaaagcgtctagcgctacttctctcacattacttttcttcattcattaaccctaatttctgtccaatttcgatatttgcgcctcttaggaagtcttcgccgctcatctttttcttaccagctggctgtacacctgttaataaaaggccttggttattcccagttccaatgactggaccttctttttgaagctcaatcactttcccaggttcttcttgcgcttcgagtggcacttttttcgcatcccatacttttagatgagccccgttccattcagtataggcaactggccacggatttaagccgcgaacttggttgtaaagctcttctccggtctttgtccagtctaatctttcctgctctcgctttatattaggtgcatacgttgccgcttcttcattttgcggaattggtgaaatagatccgctcagaacattcggcacagtatctttcaatagtgcagcgcctgctacacttaatttgtcatgcaatgtaccgacattgtctaattcgtcgatttccacttctactttactgatcatgtcccctgcatcaagtcgttccaccatgtacatgattgtaacgcctgttttctttttaccttgaaggatcgcataatggatcggcgcgccccctcttagttctggcagcagcgaggcatgcacattgacacagccaaactgaggttcatccagtagtcgttttgggaggatttgtccaaaagccgctgtcacaattaaatctggttttaaggcaagcactttatcaatttcttcatcaaggcgtaccttttcaggctgcaagaccggaatgccgtgctttaaggcttccactttcacaggaggcggcgtgagtactcgttttctgcctttcgggcgatctggctgcgtgacgaccccgacaacttcgtatccttctgttatgagtgtttgcagcacaggtactgagaaatcaggggttcccataaatacaatacgtgccattttcttcacccttccatttccgcaagttctttttctgtataagtttgaataattttcgacgtaaataatatgccgtctaaatgatcaatttcgtgcaataaggctcttgctaaaaatccttctgcttctattgtaaatggtttgcctttcttatcaaaggcttttaccttcacatagctcggtctttctactgtgccgtataaagatggaaagctcaggcagccttcaatatcagtttgacttccttttacttcaagaacctcgggattcactaaatcaattctgccaggttcttctccgatatcgacaacagcaattctttgagaaatgccaatttgtggtgctgctagtccgactccatctagctcaagcattgtatcatacatatcatcaagcagttttttaagctttttatcgaacgtatcgacaggctctgccttttgttcaagtacgtctgccggatgtatgactattggttttactgccacttaaagccctccgttttacatcatcatatatggattcatatctattgaaatcatcaattgtttttgttccatttccttttgataatggtcttgtattttccgtagtaaacttgccagttcattttcccttttgtattttatcacgcattgatatcgatatctatctttgatcttagcgattggtgatgcagccggaccaaggatccttgtattcggtgcacagttcatttttaggaactgaacaatttgatccgtaacatgcgctgccttcgtcacttcctcatgtgatactgtcaccatcgccaaaaagtaatacggcggataggactggtggcggcgatgcagcatctcctgttcataaaaggcttcatagtcatgctgcttcgttaattcaatactataatgagaaggcgtatacgattgaatgatcacagagcctgctttttcatgtcgtcctgccctgccgctgacctgcgtgagaagctgaaatgttttttcacttgaacggaaatcagggatatgaagagacgtatcggcacttagaacaccaacaagtgtgacatcggggaaatccagcccttttgcaatcatctgtgtcccgagcaaaatatctgcttctttattgccaaaagatgtgaggagcttttcgtgagcacctttacgagacgttgtatcgacatccattcggatgactcttgcctctggcagtactttagtcagctcttcttctacacgctgcgtacccgtaccaaaatagcgaatatgctcactatggcattctggacattcagctggcaccggtgcctcgtgcccgcaataatgacatttcagccgtttttgatagcggtgataggtgagagaaatttcgcaatgaggacattgctcgacatatccgcaatcacggcacatcacaaaggatgaatagccccttttattcagaaataagacagcttgttcttttctttcaagcacttcctttaatctgatcattaattcttctgaaaacatggacctgttgccatttctcaattcttctctcatatcaattaacgaaacgtgcggcagctgctgctggttgactcggtttttgagcgtcagcaatgtaaacacgccttttttggcacgcgcgtaggtttcaagtgaaggggtagcactgcctaaaacgactgggcatcgatgccttctggctcgttcaatagcgacgtccttggcatgataacgaggcatttcctcttgtttataagaagattcatgctcttcatctatgataatcatgcctagattttcaaatggtgcgaaaacagccgatctcgcacccacgacaagcttgacttccttgcggtgaattttccgccattcatcatatttttcccctgtcgataagccgctgtgaagtacagccacatttgaaccgaaccgttctttaaaccgctgaaccatttgaggggttaacgagatttctggaacgaggacgatcgcttcttttcctttttgcagggcatgatcaatcgtctgcaagtatatttccgttttaccgcttcctgttaccccgtgcagcagaaaagtttcatgccggtcatcactgactgcttgatgaatatgttttgccgcttctctttgttctggcatgaggtcaagtgaagcagaaggtgtaaacgcccggtcacgataaggatcccggtagacctcttcatagctttctgttagcagcccttcttgaataaaggttttaagcgtttgagaactcgcgcttgtttgctgctgcaagtctttcgctaaaaaggttgtctcactcgcttgaagcaaaaaggagagcaatgccttttgtttcaccgcatttttcttcagctgctgctgtttttcttcaagcttatctttggatacagctagttggagcgtgcgcacttttttctttccagatttttgcgagacgtgataccttacctctaaataacctttttggacatgcttttgaatctgttttagttgttcggctgggatgtcagcataaagaatgctatctcgctgaccgaaaagctctttcaatgactgcggaagttcttcatctgacagcacttgaatttctttttcatatttcgccttcatggctgcagggagcatcgattgaagtgccgtaatgtgataggacaacgttttttccgtcagccagtgggaaagctccaatagctcatctgtcagaacaggtgacaagtcaaataaatcgacaatgtcctttatgcttcctgtttttacgtctgtttcttctttgacttttgtcacaaacccttgaatcttcctcgggccaaagggaacgaccaccctcattcccgctttgacgagatctttgaagcgatctggtacacggtaatcgaatggccggtcaatggctttcgttgtgacatctacgatgacttcagcaatcattctcgatcacactcttttggcaacagctgttttgcctcctttaagatttcaaaagcgaggtcttttttgctcatcatcggcaattctgttgttgtaccatctgctttgatgatggctgctacatttgtgtctgtgccaaagcctgcaccttcttttgtgacattgtttgccacaatcatatctaaatgcttggattcgattttctttttcgcataatattctacatcctgcgtttcagctgcaaaaccgacaagcacttgatgctcttttcttttccccagctcttttaaaatatcttttgtccgggtgaattcaatctctaaggcgccgtcctgttttttcattttatgagtatatgaggtcacaggggtatagtcggcgactgctgctgatttaatgacaaggtccgcttcctcgtacacagctaatgcggcttgatacatgtcctctgccgattcaacgtgcaccacatgtacatgatcaggtgcatttaaagaaacaggtcctgaaataagcgtgacatctgcccccatctgctgcgcagcctctgcaatcgcatagcccatttttcctgaggatcgatttgtaaagaaacgcacaggatcaatgacttctcgtgtaggacctgctgtcaccacaacttttttgcctaaaagcggtaagctttttggctcttcaaaaaatgcacggatgtgctcaacaattttttcaggctcctctaatcgtccttttccaatgtagccacaggctaaataaccttcactcggctcaataaaccggtagccgtcctcatataatgtgcggatgttccgctttacagccgggtgatcatacatatgcacattcatagctggtgcgatccatacaggagccgttgaagcaagtaaggtcgtcgtgagcatatcatctgcaagcccagcggccattttaccaatcgtatgtgctgttgcaggggcaactagaatgagatcggcccagtcagctacatcaatatgcgctatgacttttggattattttctttaaatgtatccacatacacctcatgtcgagacagagcttggaaggtaagcggagacacaaactcacgagcagattctgtcataatgactcttacatttgcgcctgcctgtacgagtttactagtaagtgcagctgctttatatacggcgattcctccgctgacgccgagcaaaatattttttgactgtaacattagtttgtcccccttaacggccttttcacaaattcgtctacaattcaaaaaagtcaaaaccaatcatagttttgacttttttgaacgtatcgtatctgcatagcagaagcgatgtgttattcttgatcctctttttcaaatgtcaaaagaccggcatcaatttcttcaagtgctttgcctacaaatttgtaagacttcgtattttcgatttgctgatcttgatggatctgcatttcacgtgcacggcgtgcagacactgtcacaagtgtgtattttgaatcaagtttattcatcaatgagtcaattgaaggatctaacataatttattctacccccagcatttttttatatcttggtgcgactctgtctctgcgcaggtgttctgcaaggacgatcgctttgattctttcacaagcaagctcgacatcatcgttttccacgacatagtcgtaagcatccatcatttcaatctcttcttttgcagcagccattcgatttcgaatgagctcctcagactctgtaccacgcgtaatgatgcggttctgaagttctgaaagactaggcggtgcaaggaaaataaaaagaccttctgggaatgcttctcttacttgaagtgcaccttgcacttcgatttcaaggaaaacatcttttccttcgcttaatgtctgttctacatagtcaacaggcgtgccgtagtaattcccgacatactctgcccattctaacagctttttattttcaatcatatgttcaaattcttccctggatttaaagaaataatcgacaccatttttttcaccttcacgcggtttgcgtgttgtcacagaaatagagtattcaaatttcgtatcttcctgggagaaaatggcttgtctgaccgttccttttccaactcccgaaggtccagagagaacgattaaaagtcctctttctttcataatggcgtattacccctgcccttcatctatgatttcttcttttacagaaagtctttgcgcgacagtctcaggctgaacggcagataagatgacatggtcactgtccataatgacaacagcacgggttcttcttccgtatgtagcatctatgagcatgcctcgatctcttgcgtcttgtatcattcgtttaatcggtgctgattccggactgacgatcgaaatcatccgattcgctgaaatgatgtttccaaatccgatattgatcaactttatggtcatcttctaacgtccccctgtattataaacgtctctagtctcgccgaaagagacgtactgtaaacagcatacacaatgactattctatattttgcacttgttcttttattttttcaatagcacttttcatttcaaccaccagcttagttaaatgatgatggttcgcttttgagccaatggtgttcacttcacggttgagctcctgtacaagaaaatcaagttttctgccagcagcaccgccttgcattaagatttgctggaattgctgaaagtgacttttcaatcttgtaatctcttctgtaatgtcacagcggtcagcaaagatcgcagcctctgttgtcaatctgctttcgtcaagcgcctctccgatccagtcttgcaatcgctgattgagcctgtctttatactgactcacaacctctggtgcaaagactttgatttcttctgtgtaggcctctaattcagaaagcctcagctcacagtctttttgaagtgatgttccctcctgctctctcatgaagcaaagctctttgacagccgtttcacaagcttccatcagcaattgctctaattgctcatttcggctggacgattcttctacttgaacggcatgctccagccccagtaagtcatgtgcatgctgaatgcctgaaatgtgatagcgtttctcgagatcttttgcggctttcatgtattcatcgagcagcggccagtcaatctgcaaggaccggcttgctagtttaccgccttcaatcgtaacaaacagctcaattctaccgcgctgcacgtgacgaagaatgattttttttaatgtgtcttcgaaatataaaagcggcctcggcaaacgggcatgaacctctttaaaacggtgattgaccgattttagctcaactgacactgtcagttctccatccgttttactcgcttggccgaatcccgtcatactgcgtatcatgtcaaaacacccaattctttcatattaataaaatgaaaaaggtaatagcagacactattacctcaaaattataccataacgaattatttttttcttgtcaaaagtgatcctgccagtaaaaaagttggcagtgcagacataccgatgatcagtagccaatcaattgctgcaatcgccaccgttttgaaaattggctgaagcggcggataataaatgaccacaaacatcaataaaagtgatgacaaaaccgcgccgatcaagtagagattaccgaatggattgcgctcaaagatggatcgttcactgcggcagtcaaatacatgaatgagctgcgccaacacaagtgtactaaatgcaacagtctgcgcatatggcaggttgttcggatcacggtgatacacaaacataaatgctaaaagggtcgcaagtccaatgaggaaccccctagatacaaccttccatccgagtcctctagcaaaaatcccctctttcatattcctcggctttcttttcatgacatcgccttctggcttatccatgccaagcgccatcgccgggagaccatctgtgacaaggttgacccataaaatttgaataggaacgagtggaagcggaagcgctagaagcatcgcaaacagcataaccaaaatttcccccacatttgatgccagcaaataacggacaaatttacgaatgttttcataaatattccggccttctttaatggccgatttaatggttgcaaagttgtcatcaagtaaaataagagaggaagcttccttggcgacatctgttccagtgatacccatagagataccgatatctgcttgcttaattgcaggcgcatcattaaccccgtcacctgtcatcgctacaatatgtccatttttttgataggccttcacaattctcagcttatgttccggtgatacccgtgcaaaaacgtatacattttcagccgtttgctcaagctctttgtcactcatgtgatctagcgcttttccgtcgagcacctttccttgctttggtaaaagactcaagtctttcgcaatcgctttggctgtttccacgtgatcccctgtaatcatgactgtttttatgcccgcatccctgcactctttaatcgctcgcctcacttcaggacgaggcggatcgatcatgccctccaacccaataaatgttaaatcagtttcagcctgctggacagtgttgattgtttcagtcagcccaacttttttatacgcaatggcaatcgttctcagcgcctgccttgctaaaccttgaatcgcagcctctgtttcttgcctgtgagtggttgaaaatgaagctgtgcggccgccgtgcatgatatggcttgaacggttcatcaggacatccggcgcaccttttgcaatgacgtaccgctctttttgattcgtttcgacgacgactgacatcatctttctttctgaatcaaaaggaaactcttctaccacgtgaaatcctgcttcgatgaattgctctgtaaaacccgctttacgtgctgcggtgagaagtgccccctctgtcggatcaccatcaagcctcatttcgccatctttttcaacgatggtcgatgtattacaaagcgccccgtataataacaccttttgcaagcttggatgtttgtctacatggacaagttctccgttcaaggtgaaatcaccagatggctcatagcccgtaccagaaatattccacgttttgccctctgcccatacatgggtcacagtcattttattttgcgtcatcgttcctgttttatctgaacaaatgatcgacgcgcagccaagtgtctccaccgccgggagctttctgacaatcgatttttgtttgatcatccgctgcactcctaaggaaagtgcgacggtgacaatcgccggcaggccttcaggaatggcagcaaccgcaagtgatactcccgcgaggaacatatgatacaaatcatgtccttgcacaacaccaagaaccacaacgagcaccgttaaaaataaagcagccacaatgaggattttccccagctgttcgagacgtctttgcagcggtgtttccatattccctgctgcatccagcatgccagcaatttgtcccatcgctgtattcattcctgtcccaatgacaacgcccacgccgcttcctctagtgacaagcgtccccataaaggccatgttcgtcaaatctccaagcgagacatgattgctagaaagaggacttgcgtgtttgactgctgggatggattcgccagtgagagcagactcctcgatttccaggctctttgtttctagtaatctaatatctgccccaatccggtctccgcttgaaaatttcacaatatcccctggcacgagatgtttagacgggatcttgatccattcattatttctccttgcatacacgtgcggggttgataattcctttaacgcttgaagggatttttccgcccgtcgttcttgataaaagccaagcactccattaatgagaacaatcgctacaatggctactgcatcaatgtattcgcccaggaaagcagaaatgatcgttgctgcaagcaagattaataccataaagtctttaaattgcgctaaaaaaataatcagagccgatgcctttttcccttcctgcaattcgtttggcccgtgtttttcaagccgtttttgtacatctttttctgacagtccgtcacctatcgatgtattcattgtttttaataaatcggtttggttcagttcatgccaattcatttgacctcgtccactcctcttttgttctctctcatatgcagtgttctataagccagtttattcagactcgtcctaaatcatgctataataataagactgcctaaagaacgagaaatggaaggttctttcagtagatttgtgtgaaagaagagggtgtatccaacatgtcatttgacggcatttttacatatggtatgacaaatgaattgcaagagacattaactggcggtagaatttcaaaaattcatcagccatataaacacgagttgatttttcatatccgggcaaacggaaagaatcataagcttcttttatccgctcacccgagctacgctagagtgcagctcacagagcagcaatatgacaatccaagcgaaccaccaatgttttgtatgctccttagaaagcatcttgagggcggatttattgagcgctttgaacaaattggatttgaccgggtgatcgtacttcatgtacgaagccgcaatgaaattggcgacgaacagactcgaaagctctacattgaaattatgggaaggcatagtaatttgattcttgtcgaagatgacacgcagcagatcatcgatggcctgaagcatctttctccatctgtaaatagctatcgaacagtgcttcctggtcacgaatatcttttgccacctgcgcagcaaaaattaaatccgtttgcagtaacgaaggacgatattttaaagcatttacgctttcaagaaggaatgatcgcaaagcaaattgtcgatacattctctggggtttctccgctgtttgcaaaggaagctgtacacagggctggtctagccaatcaggaaacaattccaaatacactgctcgacatgttccagcttattcgcatgcattcctttaccccgcagctcacaagaaaagacggaaaagaatatttctatttattagaactgcatcatgtcgatggtgaaatgaaaacattcgaatctctcagcaagctgcttgaccgcttttatttcggcaaagctgaaagagacagagtgaaacaacaagcgtctgaccttgaacggtttgtcgtaaatgaaaaaaagaaaaatgaaaacaaactcaaaaaactgaacagaacccttgaagaatctcaaaatgctcataaataccagctctatggtgaattgctaacagccaatttatatgccatcaaaaaaggggataaagaagcaactgtcatcaattattacgatgaagatggcggagaggttacgataccgctgaaaacaaacaaaaccccctctgaaaatgctcaggcatatttcacaaaatatcaaaaggcaaaaaatgcaatagaagcggtcaatgaacaaattgaacggacacatgaagagatcacttattttgatgagttgattcagcagctgtcctctgcctcaccgaaggatttagaggaaatgagagaagagcttgttgaggggaaatatttacgcgccaaacaaaagcgcaacgccaaaaagaaaaaaacgtcggccattcagcttgaaacgtatgaatcgtctcaaggtattccgattttagtcggaaaaaacaacaaacaaaacgagtatttaaccacaaaggcagccgcccgtgacgacatttggctgcacacgaaagatattcctggatcacatgtcgtcatccgtcatcaaacgcctgatgaacagacgctgcttgaagcggctcaaatcgctgcctacttctcgaaagcaaaagagtcgagctccgttcctgtcgattacacgaaaatccggcatgtgaaaaaaccaaatggagccaagcccggatttgtgacgtatgatcaacagcaaacattatttgtcacgcctgacgaagatgtcgttctaaagctgcgaaaataataaaagccgataaaatcttttaaagagattttatcggctttttctttgttgtttttttctttcgatatagagagcatcaagtgcatctacatcttcttgttcaagcaatgtctcaatttccgcagccagttgttttgtccgggctgggctcgcaccgcttgtagagactgaaatcgtcacttttcctgctttgaccacctttggcacgatcacattgccaagctctgattggctcacacaattcacaagctgatgaggtcgtgctgtttgggcaatccattcatttaccgctggatcgtttgtagcagcgacaatgaaaaatgcatcctctacatcttcagcctccactttcttttctttccaatgcaggttgtatgtatcaatgagacgtgccatctctttagaaatgtcaggactcacgatggtgatatggcaaggctctatgcatagcgcctctgcccttcttgcagctatttttccaccgccggcgatgagcacttgttgattggttaaatcaagatggactggaagcatggcttactccttggaaatgaaacacatcatctttgtttaaaatggtttctttaacgcgttcaatataagctgcttttacatgcggatgaaagccaatataccggcatacccggacatctttcagcctctctctcgcctgagcggcttcattttcaatctctttcattaaaatacccgtaaacaacaagtagggaacgagataaacaggtgtatcatcatttgctgttaatttcgcaagaacatctcggtaatttggctcacatgccgtaataaaacatggtaagacctctgcgagaggaagcagccgccggacatcgtccgcaatgccaaacacatctcgcttcacatctggatcagagcttccacggccaattaaaagaatccgtgctttcccgccttgatatcctgcttcttcaattcttgcagcaactgcttttgtcacttcttgattgaccccaattggtttcccgtaggtgaccttcacttgcgggtatcgtttttgtactttctcaatctcaactggaatatccgacttagcatgcattgcagttaaaaggaggagcgggacgatcgcaatgtgtgtagctccttttttcacacaggcttcaaaaccttcctctatagaaggggctgtcagttctaaaaaacaaatttcttgtatttcggcttctactaacggcatacagcttttcataaaagaaatggctttatcttgtgcttctttcaccctgcttccatgcccaacataaagtacagcttgtttcatgtgactcctccttcttacttgttttgttcagacgaaaagacacgatcaatgcacgtgtcttttctctaacattctcaattctcaatgagagccggttcaaaccagttcagcttttggtgaaaatgaacgacatctccaacaactattaagcttggatgctcgataccttctttttcaacggtttcagacagtgtcgccacagtgcagcaagtcgtcttttgccttgtcgtggttccccagtgtataaacgctgctggcgtttcaggatcgcgtccattttttatcagaagctgctgcactctttctacgtttttgacgcccatgtaaatcacaagggtatcaatccccgtagctagtgcctcccacttttcttcaaaatgctcatccttttgataatgacctgtgacaaacgcaacattcgagctgaattcacggtgcgtcacgggaatgcctgcataagcagctgctgcaataccagaggtaattcccgggacaacttcatatgaaattccgtgctcagctaagcattcgatttcttcaccgccgcgtccaaatacaaaggggtcgccgcctttcagccggacgaccacattcccttcctttgcatgggtgacaagagcttcattgatggcttcctgtctcatcgtatgatgattcgggagcttgccgcaataaattaattccgcctcgggtttggcgtgggcgagtatttcttgattgacaagacgatcatataaaatgacatctgcctgctgtattgccttatgggcttttaatgtgattaagtctggatctccaggcccagcccccacaatgtatactttccccatcgtgcttttctccccctgccatcaggcgattatttcgcttttccttttacataatcaacaagacgctgtttggactcttcacgcgataattcacctgtatctagaacaagctcaggtgctgccggctcttcatatggcgaatcaattccggtaaaaaatggaatttctccatttctagcttttttatataacccctttgggtcacgctcttcgcatacattcagatcacatttcacaaacacttcgtgaaactctcccgcttcaactaactgtctgacaatgcggcggtcttcttgaaatggtgaaataaaagccgtgatgacaatcgttccttgctcaacaaataatttcgccacttctccaatgcggcggatgttctcttttctgtcatcatctgaaaaccctaaatctttattcagaccatgccgcacattatcgccatcaagaacagtgacttgataaccttgttcaaacagctctctagccgctgcatttgcgattgttgatttacctgatccacttagacctgtgagccaaataatgccgcttttatgattgtttttctgttgatattctttttttgtaatagatgaatcatgccacacgatatgttcgttgctcatgtcataccctcccattaagataccgtcgtttttaatccttcgattaatgtttcaatgacctcttttcggctgaacgtgctaggcggtaattctccgtttctgagcatcgttcgaacctttgtacctgaaagaatgacatgctcgcttttatcgtgaggacatgtttttggcgttgccattgcttcacatgtattacagtagaagctatgttcaaattttaacggggtaataccaatttcttcgcttgtaaattgttcaaataactcctgcgcctcatatgtgccgtaataatcaccaacacctgcatgatctcttccgacaataaagtgagtacagccgtaatttttacggacaagcgcgtgaaagattgcttcctttggtccagcataacgcattgccgcaggaaaaacacctaaaaagacgcgatccttagggtaataaccgttcaataacacttgatagcttttcattctcacgtctgccggaatatcgtctgattttgtttcaccgacaagtggatttaaaaataatccatcgacggtttcaagtgctgtcttttgaatatattcatgggcacggtgaacagggtttctcgtttggaaaccaacaatcgttttccagccgttctctttaaaatgacgtcttgtttcttccggctcatacgtaaattgagggaatggtttttcgctgcgtttcgtcagtgtgattttaccaccaatgtatgtgtcaccgcgttcaaataattttttcacacctggatgattgcggtcatcagttttatacacattcaccgcttctttttccttatctggtgtgtattgatcctctacttcaatcacgccatatacagttccattatacgatagacgcacaatatcgccttgatggatttcccctgccttttcctttgtcactggcaatgtaataggaagagaccaaacgacaccacttgctagccgcatactgctcacaacagattcataatcagcttttgttaaaaacccttcaattggactatacccaccaattgctatgagttcaaggtctgcaaaagagatagcatctagttcaatttcctttgcagccgtgctgagatcatattcttcatttactcgattaattaatacgccaccatgtggtgttaaactcatttgtatcttcctctcaatgttcatatttagtagatgttaatagtcggatttaacattaaatcccgccgccctgttcatgaatcgagctgctttcatttttgactgccttcatcaaacttagcgcaccaagtgaggcaagcagtacactcatcatgataaaaatagagtaatagtcaccttttaagaaaaggctcactagcaaatacgatagactaagtgataaaaagggtgatactacccacactttcagcatttttttcaccacatgtttatgaaaaatattaggtccaccttttgccatgccaagtccaatgatagacgaggaggtgatttgggtaagtggaactggcagcccaaaaatagagctgacgatgacaagtccagcaccggtaccggaaagcaatatcccttcgcccgtttgatagcgggtgattttctttccgtttgtttccagcacccttcttcctaataaaagagcacccagtgcaacgaaaagtccgccgtaaagcgttccttgcccaacggataaaatgcctgaagcaacaagggggcctacagcatttgcgacattgttcatcccagcagaaaatgcttctagaaatccactgatgatcaaaataatcgataaaatcaaagtgcctttttttgaaaaggttcgtttcgggaacattctgatgattttgactacaatgaatgtaaaaagaaaagcaacaataggaatgatgacccaaaaggacacgatgactaaaatggatttcacatacaatactttatacgcgaccgccactccaacgacagcacctactgtcacctcactcgttgataaagggatagccatcaaattcgctataaagagcgataaagcagcagaaccaataataatacatacaatttcaagtgtaatgacagattcaggcataatgccagagctgatggttttgacgacctcaccgccgccaatgactgaacctgctaaaatcccaactgcacatacactgagtgcatagatcggctttcgaatcgcacctgatccgtatgcgatgcccattgaagcagctgcaccactcgcgccaatgtttagcgcgaaaaataaactaaataaaattgcggcaatttccatacattatgctcccttactcatgtaatccgcactcagtcttagctgtgcctgaccatctgccagaccgcagatcctcggcagtaaatgctggctgtgtacacggcgcacagccgatacttggatatccttgatcatgcagcggattataagtaagttcctctctagatgcatatctccatatgtccttccacgtccagtggataagcggacatactttcactgatttgaatttttcatccttatttaaaaagttcgtccctgctcgcttaggtgactgctctcttcttaagccagaaagccatgccggatagccagataacgcttcttgcaaaggaatgaccttacgcatatggcagcagctttgagggtccgttttccatagttgatcaccatgctgctcgttttgctcctcaaccgtcagctcaggggttttcagcacaatatctaaacctgggtatctttcctttaccgcatcaattgtgtcgtacgtttccttaaaatgcagacctgtatctaaaaagacaattcttgcatccttttttaccttcgcaatcaaatcaatgaggacgatgccttcaataccaaaactacatgcataaacgagctgatcaccataatgaccgtatgcccatttcagcacagataaggcccctttatacaaatcgtcttcttgaaatgtaatggacggctcttgccaattttcataagttaacattgtttctccccttccggagtatcactactctccgcactacgtcaactgaattttttctgtcttcttccacttgaatcacttgaccgtcctgaacaatcagtgtaactaaactgaatcatatccccaatcagtttctgcataggcttcaattaagtcttcatcctgcttttgctctcacttcctcctcatcgttaaaataaaaaaactccctttcagtccgaaagaaagatgaggaagcttacgatttccttatctttcaaaatagaatcattttgcaggatgtagcaccttgcaaatcgcaggttgccgggcttcatcgggccagtccctccacctctctggataagtgttttaatttgtcttaaatattaacacaattcaaacaaaagtcaacccgactttattgataggattagtttttatttaaatttgagtctattttactattttcaccaaataaaaaagctgtgcgggttcgcgcagcttcagattatattcagcatgatagaaaaccattgcagtctaggaaagacgagtaccagagcggagcgaattgaacattcgtgagcactggcacgcagtcctgacaaagaatgcgagagtttgtctacacgctgaaagctgtgcggggaggcgcagctttttagacggtttcttccatccaagattcagaggaaggatcttgtctccagcgtttcagtttattcatagcagaaggctcaatcgctttcagctcaagtgccacgtctgtcagggtgtcatagtctgttagtgtgacatatggaatgtttttctcttggaatgctgccgcagcttttggcagaccgtatgtgaagattgcagcaacgcctagtacgtcacagcccgcttcttgaagagcagcgaccacttcaagcacactgcctcctgttgaaatcagatcttctacgacaaccaccttttgaccttttgatacggcaccttcaatttgattcccttttccatgtgcttttggtttacttctgacataacacatcgggacgttcagacggtctgccgctaatgccgcatgcgggatgcctgctgttgcagtaccagcaatcacctctgctccctcaaaatgagtgagaatcaactctttaagaccttcagcaatgtcgtgtctgacttctggataggacaaggtgagacgattgtcacaatagatcggtgatttgataccgcttgcccatgtaaacggttcgtctggtttcaatgagaccgctttgatttgtaataggtgtttagcgatttttgttttcatctggcagtcactcccactctttcaaaatttgatgataggcttccaatggtttttcagcttttgtgattgaccttccgacaacaatttgtgaaacaccttgctcttttgcataagcaggggttgccacacgcttttgatcatcggtttgatcatttagtaaacgaatccctggcgtaacagtgaggaaatcaggtgagatgtgctcatgaagggctttggattcatgaacagagcaaacaacaccgtctagtccactttcatatgccaattgaccgtaccgaataacagtctcttgcagcggacggtctatgagtaattcgcttctcatcatgtcttcagatgtactcgtcagctgagtcacagcaataatgcccggacgtttttgtccagcaggcgttccgctttcaagcccttctaacgcagcttgcatcatctgtttcccgccagcagcatgtacattaactagatcaacgccaagtgcggcaagccggttcattgcttttttcaccgttgttggaatgtcatgtaatttgagatcgaggaaaatgcggcaatttttttctttaagcgcctcaaggatgacaggtccttcttggtaaaacagctccatgccgaccttcacaaataacggtgtcccttcaaagggttctaaaaaggcgagcgcctcctgccctgatggaaaatcaagcgcgatgatgggcaagtgcttcatgtttccagctccttccgatacattcctctacagatgaatacccataggctgataatacttttggcagttcttcaatgatttctgggcaaataaatgggttcacaaaattggctgtgccaacagctactgcactcgctcctgctagtaaaaattcaagtacgtcttcagcattttgcaccccgcccattccgataatcgggatagacactgcttgactgacctcatgtaccatgcgcacagcaacaggtttgaccgcagggcctgataatccgcctgttttattggcaagaatcggtttccccgtttttaaatctaaacgcataccgattaacgtgttaatcatcgtgagtccatccgctccagcagattcaatcgcttgagcaatctccacaatattggctacgttaggagacagtttgacatagacaggaacggaggacacgtccttcaccgcttttgtcaatgctgctgccatttgaggatctgtaccaaaggcaattccgcctgttttgacatttggacacgagatattcagttcaagggcatggacattttttgcttggctgatctgcttcgctacttcaacataatcatcgacctgtgagccagcgacgtttgcaataataggcgtatcaaactgctcaagccaaggtaattcattttcaagcacgcctttcagtccaggattttgaagaccgatggcattgagcatcccggcacctgtctccgctacccttggtgtcgggttgccaaatctcggttctaaggttgtggctttgatcatgataccgccaagcacggataagtcgtataatgaagcaaattctcttccgaatccaaagcagcctgacgccggaataattggattctttaatgataagccgggtaactcaacgtttagcatgacaatgccacctcctctgctttaaatacaggtccgtccagacagactttgacgtaagctttttcgtgctggtctgtatgacaaacacatgcaaagcaagcaccaatgccgcagcccattcgctcttccattgaaatgtagacaggcttatcggggtaagagtcttttagtgcctttaacatgggggtcggcccgcaagaaagcatgacatcaaaactcaaatcattctcttcaataacacttgtcacgaagccctttgcgccatatgtcccatcaactgttgcaataaatgtatctccgagtgcttggaatttctcctcgtaaaatatatcctttttcgattgaaagccaaggacatgcttgacgatgacgccttttttcgttaaacgcttggacagctcatataaaggcggtactccaatcccgccgccgactagtaacgctgtctgacctggctgaacaactgaaggatcatatccgttgccaagcggccctaatacatcgatggattccccatcccgcttttgggaaaggagctttgtgccctctccctctgcgcgatagatgatggttgcttcttgtttctcggcatgaatattggcaatactgatcggtcttctcagcagcggtgtcatggactcgctgaccttgatatgaagaaattgtccagccgtttgaaaggagtccacaaggtcaccttttaatgtcatttcgtaaatatgatcagcgatctctcgatttgagacgaccgtcaagtatgcttttttcatatcgttactgtcacctcagcattcgttttcacttctggcatttcgtccgctctaaatgtcatgctttctagtactcttaaaatcgcttctgctgtatctaatgacgttaagcaagctacgccattttcaacagcttcacgtctgattctaaagccgtctcttgccggctgttttccttttgtcagagtgttgatgacaaattgggcttccccgtttcgaatgacatcgagaagatttttgccttcttctcctattttgccgacaacacttgatgggatggaggcttgttttaagtaattcgccgttccttctgtcgctaatatatggtagccgattgaatggaatcttctcgcaatctcaagtccttcttctttgtccttatcagcaactgtcagaagaactgtcccgtctttaggaatttgaatgcctgatgcaattaatcctttgtaaagagctttttcgattgtgacatctttccccatgacttcacctgttgatttcatttcaggtccgagtgtaatatcgactcttcttagtttcgcaaaagagaagactggaactttgacgtacacgccttcttgctctgtgtgaagtccttcttcgtagccatagtttttcagtttttctcctaaaatgacctttgtcgccaggtttgccatcgggatgcctgtgattttacttaagaaaggaactgtccggcttgaacgcgggttcacttcaagtacgaacacttcaccttttgagagaacaaattgaatgtttagcagcccaataatgttgagtccttttgcaagcttgatcgtgtaatctgcgatcttcgctttgatctcttcagacaatgtttgcggcgggtaaaccgcaatcgagtcaccagagtgaaccccagctctttcaatgtgttccataatgcctgggatcacgacggtttcgccatcagacacagcatctacttcgatttcttttcctgtcaaatacttgtcaatgagcactgggtgctgcggattgactttcactgcattctccatgtagtgaagaagctcagcttcttgataaacgatttccattgcgcgaccgcctaatacataggaagggcggacaaggactgggtagccgatctgattggcaatcgctacagcttctggcacagatgtagctgttttccctttaggctgcggaacgccaagtgcttctaatgtttgttcaaacttgtctcggttttccgcgcggtcaagatcttcaagggaagttccaagaatcttaacccctctatttgataattcgtcggctaagttaattgctgtttgtccgccaaactgaacgacaacaccttctggtttttcaaggtcgatgatgtgcatcacatcttctacagtgagtggttcaaagtagagcttgtctgaaatactaaagtctgttgagaccgtttcagggttgttgttaataataattgcttcataccctgcttgtttaattgcccacacagaatgaacggtcgcataatcaaattctactccttgaccgattctgataggacctgagcctaatacgatgacgcttttcttgtctgtacgttctgattcattttcatcttcatatgtgctgtagaaatatggcgtctctgattcaaattcagctgcacaagtatctaccattttgtaaacaggtacgatgcctgcttcttgtcttagcgtgtagacatccgcttctttcatattccactcgcggctaatatagatgtctgagaagcctttttctttcgcttcttttaatacgtctgtattgcctttgttttcttttaatgtcttttcaaaagcgatgatgccttccagcttatgaaggaagaagtaatcaatttttgagaattcatgtatctgttcaaccgtatagcctcttctaagcgcctcggcgatatagaataatcgttcgtctcccgccttgataatccgcttttcaagcacttcgtttgtgatatctgcttcatcttttaattcaatgtgatgcacatcagcttcaagtgaacggacagcctttagaagagactcttctaatgtacggccgatcgccattacttcacccgttgctttcatttgcgtgccaagacgtctgttggcagattcgaatttatcaaacggccagcgcggaattttagacacaatatagtcaagtgccggttcgaaggcggcataggttttacctgtgacagggttcatcatttcatcgagcgttaagccgacagcaattttcgctgcaagtttggcaattggataaccagttgctttcgacgcaagtgcagaagaacgactcacgcgcgggtttacttcgatgatatagtattgaaagctgtctggatcaattgccagctgtacgttacatcccccttcaataccaagtgcccggatcagcttgagcgacacattgcgaagcagctgatattcacggtcacttaacgtttggcttggcgccacaacgatactgtcacctgtgtggataccgactggatcaaagttttccatgttacaaacaacgatcgcatgatcaccgctatcacgcatgacttcatattcaatttctttaaagcctgcaatacttttttcaagtaagcattgtgtgactgggcttagcttcaaaccattttcgacgatttccttcagctcttgctcgtttgtacaaattccgccgcctgttccgcctaatgtataagctggtctcacaatgacagggaaaccgatttggttcgtaaacgccatcgcttcttcgaggttatggatgatttcactttctggtacaggctcatttagttcattcatcaaattacggaatagatctctgtcttctgctttttgaatagctgacagctttgtaccgagtacttcaacgccgcattcagctaatacgccaaggtctgataattcaacagcaaggttcaatccagtttgtccgccaagtgttggcaaaatcgcatcaggacgttcttttcgaatgattcgtgttaagaattctggtgtcagtggttcgatgtataccttatcggccatttctgtatctgtcatgatggtcgctggattggaattcacaagtacgacttcatagccttcttcttttagtgctaagcaagcctgtgtgcctgcatagtcaaactctgctgcctgaccgatgatgattggacctgatccgatgactaaaatctttttgatgtctacgcgttttggcatacttcttccccttctttctcagttgtatgaatcatgtccatgaactggtcgaataagtagttggcatcttctggacctggtgatgcttctgggtggtactggacagtgaatgctggtgcttctttatgttttaatccttcaattgtattgtcgtttagggcgatatgtgtgacttcgagcacatcctcgttaatggcactaactgtgtagccgtggttttgagatgtcagtgtcaccttgccagttgctagttctttcactgggtgattcgatcctctgtgaccgaatttcattttttcagtacttgcgccgcatgcaagcgcgaataattgatgtccaaggcaaatgccaaagagcgggacctttccaatcaattgctgaatcatctcgactgcttctggtacatcaacaggatccccaggaccgtttgaaagcatgattccatcaggctttaactgcagtacttcatctgccgtgatattgtacggcaccacgatgacatcacagtcccttttattgagctcacgcaaaatgccgtgcttcatgccgaaatcgacaaggacaattctttttcctcttcctgggcttgggtacgcatttttcacagaaacttgacttacttgatcagtcggaagctgcattgtttgaaggcggctaatcacgtcttccacttgttcatcaggtcccgcaaatgctccttttaaagttcctgcacttcgaatcattctcgtcagctttcgtgtatcgattccgctaagccctggaatgtttttcattttcaaatactcatcgagcgagtatgaagagcgccagtttgagggcttttcgcaaagctccttcacaatcagcccttttacaaacggtgtgatcgattcaaaatcatcacggttaatgccgtagttgccgataagcggataagtgagtgtgacaatttgtccgcagtatgatggatcagacaaaatttcttgatagcctgtcatccctgtattaaagacaacttctccgactgatgattctaagctgccaaagcctgttccttcgaatactgttccgttttctagcactaagcgtctcttcattttactagtctcccctcttcatacacgactttcccagatgcaagcgtcatgaccggccatcctgatacagtcaatttgtcaaacggtgtattttgccctttagataagaagctctttttatcgattgccatttctttgtttaaatcaatgagtgtcatatcagctgtttgtccttcttccagctttccataaggaagggagaaagcttctgctggcttgatcgtcatataatcaacgagttcttttaatgtccattcgcccgttttgacaaatcgtgtatacagaagcgggaacgctgtttcaagcccgactattccaaaaggtgcgcgctgcatcgtttcgttcttttcttcttctgtatgcggcgcatggtctgttgcgatgaaatcaatcgttccatctaacagtccctcgattagtgcctcgcgatcctcttttcctctgagcggcgggttcattttatagttcgtatcaagccctgggatgtctgcatcacataagagcaagtgatgcggtgacacctctgccgtcacacggatgcctactttttttgcatcgcgaacgactcgcacagattcttttgtactgatatgacatacatgataatgacagttcgctgcttctgctaaaagaacatctcttgcaatatgcaccgattcacaaatggacggtattccgtttaattcatttgcttttgaaaattctccttcatgaacgcatccgccgtaaataagcgagttatcttcacagtgtgccacaattgcttgatcaaggcttgccgcctttttcatcgcttcgtacatcatgcctgctgtttggatgcctaccccgtcatctgtgaaagcgaaggcgcctgcttcttttagtgctgcaaagtctgtcatctcttccccaatttgtctagttgtgatggaggcatatggcagtactctgacagaagaagtctcttcgattcgattcatgagccattccatttgctcttttgtatctggaactggacgtgtattcggcatcgctgcgatcgttgtatagccgcctcttgctgctgctttagagcctgtttcaatcgtttcctttttctctccgcctggctctcttaaatgtacatgcagatcaattaagcctggtgaaacaaatagccctttagcatcaatgacctcttctccgtcttctctttctaagtgaccaatcgcttgaatcacttctccttctaccctaatatcctgctgcactttttcacctgtgcttgttaagataaaaccgtttttaatgagatacgacatagacagaatctctccctttttgatgtagtctgctattttgaaaagctctttttaataccgccattcggacataaacgccattttccatttgcttgaaaattcgtgactgctttgattccactaaagaatcatctatctccacacctctatttactggcgctggatgcatgataatggctcgttctttcatgttgtttgccctgtttaccgttaatccataagtcgataagtaatcttcattgcccattttttcagcgtgccgttcatgctggattctaagcagcatcaccacatcagattgtctaatggcttcgtctacttggacatacgttccgtgaggattttgctcatcttggaaggaagcgggccctgagaaaaggactgtcgctccgagccttgagagtacttcagcattcgaccttgccactctgctgtgtttgatgtctccatgaatcgaaatcgttaagccctcaaagcagccaaactcttcatagatggtcattaaatcaagcagtgattgggtcgggtgctgcccgcagccatctccagcattgatgatgggaatcccaaccttcccgattagctcgttgtagtattcatcagtgctgtctctgatcacacatgctttcacgccaatggattcgagcgtttttaccgtatcgtataatgtttcgcctttttggacggaggtgcttgccgcatctaagttcagtacattcatccccagtttcttttcagcgacttcgaagctaaatcgtgttcttgtgcttggttcaaagaagaggtttgctacaaattctcccgctaagccaagctcttgtttcccttttttgagagccgttgcttcttcaatcagctgtaaaatctcttctttagataagctgctcattgtcgatagattattcattttttctgccccctctagtttttcatcactttcaggttcaaaaaaaccctaagcgtcggcagcttagggttctccaaaagaagcagcggcacattcgtgcattctgctcattttagaacccttgtcagcctcactggacttcttttaaaaggttttctgtattcgattcatttgactcgtcatcggccgctttttgctgcggcaggatcagattcaacaggacacccgtgatggcagcaagcgccattccagatagtgtgaggttgatttgtttcacctcaatgaatgccccgccaattccgatgactaagatgactgatgcgataatgagattccgcttttcttcaaaattcactttatgatcaatcaggattctaagaccgcttgaggcaatgatcccaaagagcaggaacgaaacgcctcccatgaccgcagacggtactgtactgattaatgctgagatttttccgacaaagccgaagcagattgcaaatactgctgctccgccgatgacgaagatactgaacactcttgtgatggcgaggacgccgatgttctctccatacgttgttgttggtggtccgccaatgagtgaagcgaagattgtcgccgcactgtctcctaaaatggagcggtgaagaccaggttttttaatgaaatcttgccctacaactttacttaacaccacttggtggccgatatgctcagacattgtcacaaaggcaaccggcaccatcaccgtgagaatgcttaatgtcacaacaggtgtgtaattgacaaatggtacgacgaagtctggtacagcaaaccattttgcatcaatgaccggctgaaagttcacaataccttgtgttaaggcaaagagatagccgcttataatgccgattaatactggaattaagcttaggaaacctcttaggaaaatcatgctgataatcgtgacagccagtgtgaaacccgcgaccgttaagtgcttaaggctgtatacaagctcggttgcattcggatcaacatacatcgccatgttaacagctgttccagcgagtccgagcccgatgaccataatgaccggtcctacgacgactggcggcagaagcttcatcagccaacctgtgccgagccatttaataaatagtgcaatgagtgcataagcgacacccgccatgaaggcaccaaccattgcggctccagggccgcctgttgctttgacattcagtatgggggcgataaaggcaaaggacgatccaagatacgccggaatttggcctcttgtgatgattaagtaaacaatggttccaacaccacttgagatgagcgcgacggctggactcatatcgatgatttttggtactagaatagtcgcaccaaacatggcaaacaaatgctgaaggctaagtgacagccatgtgaatggttttgggatatctcgaatgcctaaattggctttttgctgactcatgatttttcctcctagatgtgtccttcttcattaaaaaagcctctttgcgagtatgtgcaaagaggcttagaaaaaccgtacacgtcatgttaaccgtgctcagtgtctctgttattgccctctttgcaaactctctggaatgcatttaaaaaggttatttttcatatatagcgacaaggtcgttttgatctacttcattcagttgaaccatcactgtctctgcttttgatgtcggaatgttcttcccgatataatccgctcgaatcggcagctctcggtgtccccggtcgacgagaacagcaagctgaatggaagatggtcttcctacatccactagggcatccatggctgctctaacagttctgcctgtaaacaggacatcatcaacgacgattagtgttttgtcattaatgtcagctggaatgtctgcaccctttacaagcgggtcttggttgtctgtcttttttgtcaggtcatcacggtatagcgtaatatcaagttcacccactatgactggatttccttcaatttgctcgatgcgctctgcaaggcgctttgcaagatgaatgcctcttgtcttgatccccgcaaggatgacatctttcatccctttgttgcgctcaatcatttcatgtgcaattcgggtcagcgctcgtctaatcgcttgttcatcaagaatgactgctttttgttccatcttttacacctctttttgacaaataaaaagccccttctgcaaagggcagagaggggcgttcatttgtgcatacacgtgcacaaattgatccgttatccttctcagcctctctggactgttttaaagaatcttcatttcttcgttcattatttcaaaaaaagaacggcctgtcaatcgttatttcttaatgaatcgataaaagcttgcatatcggcaggaactggtgctgtgaactcgatatattcgccagttcttggatgatcaaatcctaaaacacctgcatgcagcagctgaccattgaaatcgactgtttttctcggaccatatttcggatctcctgcaagcggataaccgatatatttcatatgaacacgaatctggtgtgtccttcctgtttcaagtcggcactccaccaccgtgaaatcctcaaagcgttcaatcacatcaaagtgagtgacggcttgttttgaactttcttttgttactgtcatgctttgacggtcttttttgtctctgccaattggggcatcaattgtacctgtatcatgctggataatgccatgaacaacggctgtatatttccttgtgaccgtcttagccacaagctgattgacgagtgattcatgcgccatatcgttttttgcgaccattaacagcccagatgtatctttatcaattcggtggacaataccaggacgcatcactccattaatccctgataaatctgtgcaatgggccattagaccatttactagtgttcctgacacatgacctggcgctggatgaacgaccattcctcgtggtttattcacaactagcacatctgcatcttcataataaatatcaagatccattgcttctgcttctacatctagtgcttctggttctggaatctcgactttaatctgatcaccagcttgtactttgtaattggctttcacttgcttcccatttacttcgatcagcccatcttttacccactgctggacctgggttcttgaccattctggttctgtcgtgcttagaaatttatcaagccgttcacttgtttgttcttctgaaacggcaatatttacttgattcatgtagttgactccttcgttttctttccatctaacagcatttgaatgaagagcagaataacccctacacatagagaagaatctgcaatattaaaaattgggtagtgataattcccaaagacgaaatgagcaaaatctaccacttcctgacggaaaatgcggtcgataaagtttccaatcgctccgccaagcattaaggccagcgcaactccaagcagcttgtccttttgtccatgcttttgcaaataataaacaattcccgcaataacaacgagtgtgatcacatagaaaaaccacatttgtccttgaagaattccccatgcggcgcctgaatttcggtgtgacgtgatataaaagaagccatcaatcactggataagaatctccgagcatcatatttttgacaatgagccattttgttaattgatctaaacaaatcatcacgaatgcgattatgtaatagaacacacacgttcctccactttcatactttgatctttaagcattttatcaagaaaacagggaggagtaaagaaactttagttgacagacaaaaacctccctacatatggaaggcttcaaaatgagaatcatctgattcatgaggataaggagtgaatgcttttttctcgtattgcttatgatataaaaagtcgtcagccgtgcgggcggtaggaagaatactcatttgttcaagcggaatgatatcacctgttgcctcacatataccataagttccttgctccatttttgcaatagcgagagacacatcttgaagttcttctttgatgtgataaagaagcgtggccgtttggacctcgttcattgagacatgctcagcggatgaacgaaatgatgcgtattcaaacagtttagcttgaagctcttctttcatttgaaggagttccgtgtaaatcgtctctagatcgccattcatgtcgctatttcaactcctgccctgtcgtgataatcatattgttgccccggctgtccactttaaagccataagatttttcctttcgttctaaacgctgtcatttctgcaaacaagaaaacgccccgcatatggcggggcgctagttggtcatatcacactgttaattctggtaatatttttccacgatttcagcatttttcagtgacaatgttgggtatttcggatttgcaccaacatcttttgaaataatacgagaacgttcgcacagttctccttctgctttttgaaccacaattcgccctgaagtgtattcaggtgctgatgtgtcagcattttgcgcatcttctaccgttaattcagagatgataaagagctgcttcacatcttctttaatggatgcaagaaggtttttcacttcttctgtcgcataaagggtcacacttgcttcaagagaacgtccgataactttctcattacgtgcaatttcgagcgcttttagcacatcgtcacgcacttccataaagcggtcaaacttcgcttctgtcgcttccgcttgagaaacagccacaccttctggcatatctgttaactgaacacttggctcttcaacaaagcttaaatggctccataattcatctgctgtatgcggaagaattggtgcagtcagcttcactaacgccattaatgtttcgtagaagaccgtctgcatgctgcggcggtctggatgatccgcatgctcgatgtacacgacatcctttgcaaagtcgagatagaaagagctgagctcaattgtacagaaattgtgaatcgcatgatacacgaccgcaaattcgtaatcatcataagcctttttcactttatcaatcaatttgtttaatttgatcaagatatattgatccacttcgcgaagctcttctacaggtactgcattgactgctggatcaaagtcaaataggttaccatgcaggaagcggaacgtgttacggattttacggtagacctctgctacttgttttaagatatcatcagatactgggtgatcggcttgatagttgactgaagatacccaaagtctaagaatctccgcccctagctgcttcgctacctttgttgggtcaattgtattgcctaatgatttactcatcttgcgtccttctttatcaagcgtaaagccgtggctgagaacacctttatacggtgcttttccagtgaccgcaactgctgttgataaggaagagttaaaccagccgcgatattggtcagagccttcaaggtaaaggtctgccggacgaacaagatcatctctttcttctaaaacagcttggtgagaagaaccagaatcaaaccatacatccatgatgtcctgctcttttgtgaattcaccgtttggactgcctggatgtgtaaagccttctggcaatagttctttcgcttctttttcaaaccaaatattagagccatgttctctaaataattgtgagacgtgctgaatggtttcatctgtaatgaccggctcaccattttctgcataaaagaccggaattggaacgccccatacacgctgtcttgaaatgcaccagtcgcctctgtcacgcaccatattgaataggcgcgtttcgccccatgctggcacccatttcgtttctttaatattgtctaatagcgcttctctgaagtctttaatcgaagcaaaccactgagcggttgcacgataaatcgttggctttttcgttctccagtcatgcgggtaggagtgcgtgataaagtcgagctttttcagcgcgccttttgcttcaagctgttctgtgatggctttattggcatcctcgtaaaatagaccttcaaaaccaggcgcttcttctgtcatgacacctttttcgtctactggacatagtacgtcaagaccgtacttcatgctgacaataaagtcatcttccccgtgacctggtgctgtatgaacacagcctgttcctgcatccgttgtcacgtggtcaccaagcatcacaagtgaatctctgccatagatcggatgctctgcaacgacgttatctaattcttttccttttaatgttttcacgacttcatactcttcaaaaccaagcgtttttgccacttgttcaactagctcagatgcgacaacatatcgctcagcacccacttgaagaacactgtattctaggtttggatgaacacaaatcccaaggtttgcaggaagtgtccaaggtgttgttgtccagatgatgaattgttcgccattttcaagtacgcctttcccatctttcactttaaatgaaacgtaaatggatggtgaacgtttgtctttatattcaatttccgcttcagcaagagctgactcacttgaaggagaccagttaacaggctttagtcctttgtaaatgtagcctctcttcgccatttctccgaagacaagaatttgctgcgcttcgtactcaggctttaaggtgacataaggattgtcccaatctgctctgacgcctaatcgcttaaactgattgcgctgaccttcgatttgtttccaagcatactcctcgcatagtttgcggaattcagctgtcgacatttctttacgtttgacttttttatttttagtgagtgctgtttcaattggcagcccgtgtgtatcccagcccggtacgtacggtgcatggaatccattcattgatttaaaacggacaataaaatctttaaggattttattgagggcgtgccccatatgaatgtcaccattcgcatatggaggtccatcatgcaaaataaaggtcgggcgtccttttgtccgctctaaaaccatttgatagatgtctttttctgcccactcctcttggatttcaggctctttgttcggcaagttccctctcattgggaattctgttttcggcattaataaggtgtctttgtagttcatacccattcctccatatgcaaattctgattaaaaaacaataaaaaaagccctctcatcccataagggacgagaaggcttgtctcgcggtaccacccttttagacaagcgctatttaatcagacgcttatccactctaaaatcgtaacgtgatcagacgccttttcttactcattcttttcagaaaaggaactaaaggggtgatctcattgcagcatctcgtaatgtcaggcttccaccatccctgattcgctttattacgcatatgacaactgcgagtgtccctttcaaacgtttatctcttgttaatttatgatggtattatatgcaacttgtacacgtcatgtcaaggtgatgcgcttattctttttcgtcaaagacagcgtcaacttcatattccagtaaatgatcccaatcgtcattttttagaagatcaagctgagcttcgatgagcatttggaagcgagttctaaagactttcgactgcttcttgagctcttcgatttccatcgcaatctttcttgattttgatagcgcttcgttgataatacgatcggcatttttctccgcttcacgaataatcaatttcgcttctttatcagaatgacgtttgacgtcttctgctgcttcctgcgccacaagaattgatttgtttaacgtttcttcaattgtcgcaaaatggcctaatctttcgtcaagctcgtttactttttcttcgagttcattctttttgcgaagcacgatttcataatctttacgtacttggcttaaaaactcgtttacttcatcttcgtcatagccgcgaaagctttttgtgaacgttttattatgaatatcattaggtgttaatggcaacctcgccacctccagattcaagttcgttatgtcagaagctcaaatgttactttaaatttatcttttttggtcttcccatcaatcgttttgaggctaaagcggccaaatcccctgacagagagctgatcgccttcaccgattgtaaaagaagggtcctcagtgactttccagttaactttgacaaacccatttttgaccaacagctgtgccttttgccgagactgacggctgattgcagcacataccgcatcaagccgcagtgaagaaatcgtatcttctttgatgtcagtcttactgataaccggctttaaatctgcctgcgtgatttcctctaatgatacggaggctctgccgacatgcgtcagctgcgcacgaacaaaatcggcgacatcactcgtacaaataaactgcacatcttcctctgaaaataacagatctccaaatttttgacgcttcaagcctgtcccaatcagtgaaccaaggagcttcgggtgttctagcgaaataaactttttcgcatagttcacctgaaaataagacagttcagcatcctgagtagccggttctaaatattcaggataaatgagcgctcttttgcgctccgctccttcatacccgccaaaaaacatgatcccaagctcatcagcatgctggatgacggactgggtaataaactgctcacgcggatcaagaaagtctgttaatttcattcgatactggtcgagtgcgatttttttccagcctaacacttggtcgacaaatggctgttcgtcttttctaaaatgttgataaatatcgctcattttgttcccctcttatgtaaaagagcctggcagcgccaagcccggcagcctgtctacatgaagcgtacaatcatattgtaaagaccagttagtccatatgatgatgcaaaacgaatcacaagcaatgccacaattggcgaaatgtcaatcatgccaattggcggaataattttacgaaatggttctaaatacggttcgcaaatatttgtcagaaaacgcccaattgcagtttctcttgcagatggcacccatgacataaagatgtaaataataatcgcgaatgagtaaatcgttaataccgttcctaaaaaattaaaaatcaaatttagaatcactatgatttaccacctctgaggttcttcctctgtcaaaagttctgatattgtgccagatacatccacattatcaggtgtgcagaggaatatattcgagccaatacgctggatgtctccaccgattgcataaacagttccgcttaagaagtcgatgattcgctttgcttgatcgtgctgaatgcgctgcaaattgacgacgactgcacgtctgtttttaatatggtctgcaatctcctgcgcttctgcataaacacgcggctcacttaacaccactttagaggatttctgcacgctttgcaagctgacgacattttgtttcccagtctgcggacgctcttgaaatgccgctttgtccttcgttcctttttcttcttggactggttctctttcttcatcaatatattcgtactcatactcttcatcgtcgagagtgaaaaagcttttaaacttattttttatgctcatgtcacgcacctcctgtttcatttccaacaagtgaagagccaatccgaacgaatgtcgcaccttcttcaattgcgatttcaaaatcatttgacatgcccatcgataaatgctgacaaggtgcatttacttggttaagatgttttacttcttcttgaaggttttttaatgttttaaagcagtttcgtatcacagtgtgatcgtctgtaaatggagccatcgtcatcagtccagcaatttcaatctttttgaaatcagcgagctgcttgacaaatggaatcacgtcttcactttgcaggccgcgctttgactcctccagtgatgtattcacttgtacaaaacagcgaaccgtgtgatccgctcttttttcaatttcattcgcaagagagatcctgtcgagcgaatgtaagtagtcaatggtctgaatgacagattttacttttcgtgtttgtaaactgccgatgaagtgccagctaatgctttcatcggttatagccgcttgtttttcaagtaacccttggtcacgattttcaccaaaatgcaaaattcctgcttctttggcttcttgtgctcgttcaattgagacatattttgtgacagcgacgactgatacatcgtctgggtttcgaccggctcttttacatgcttcgtttatttgttcatttatttgtctgagattctctcgtacattcaattgctcttatgcctccttaaacccgacaaaagacatcatacgtcctgttttcccttgatcacgccggtgtgagaagaatagctgttcattgcagcttgtgcacatcgaactgacatgtatgttttcttctatcatccctgcatgaagcaatacgtttttgtttaatgtttttaagtctaatttatattgtccttgtgatatctcggaatacacatccactgtagaaaagggaagctgtttcacttgattcaagaccacatcatcaactatgtagcagcagctgccaatggatggtccaatgacgacttgtatttgatcggtcttagcaccttcttgattgacccatagatctaccatctttgcaccaatttgcttgacggttcctttccatccggcatgggctgttccgatgagtccatgttgcggagctagaaaataaagcggaacacaatcggcgaaacaaagagcgagcatgatgttcggttcagacgtatataagccgtctgttccaggcaatgcctcatgataatgaagacttcctcttcctctttgctccttggtgactttcttgatgcggtcctcgtgtgtttgatctgcaaacacccaatcagagagcggcacagcagtagcatctgctatgacttgacgattcatttggacactagaagcatcatctcctacatggagtccagtgttcaatgattgatatggagaaaggctgaagccgccattttttgtcgtaaatccggccaatacctctttaccagaacatgtcatgttcgtccaatcatgaatcatcattgcatcaggtgatttctgctgaaaggggtcataattgtgtgtcaaagctgcctaccacctttcattcatctctctttatatcgctcctattttaccacaagacatgcgtagacagttagtgggattcattaaatattacactcaaatgtgccctttctacaggtttttttgcaaattgatatgaaaacgtaatctttttacccgaaaaagacattgtttgctgagaatggagagcttatgttaaggatcattgaataattcattgaggagttatacgaattttaagaagacaatcggacaagtatcacatcttcgccaatttttactatatttcgccacggcacaatcatttcctcttcttttccgaaaaatcccatcattttacctgtgccgccgataatgattgcttgtattttaccgctcgtaacattgatatcaatgtccccaatggtgcctagtttttttccgcttgacacatcgacaacatccttgatttggaattcagaaatactgatcatctgtccttccccgcctttcgttttctactataatatgtatgatggaaaagcagggacgcagaccaatagtttcttttatctacaatttacttaagtgaggacggccatttctccacatcacatctaccgggcattcaaagaaggaagaaagcaagtcgcttgtcatcatctcttttgttttcccttgatcaaaaacagacccctcttttaataatagggtgtgctgaaaaacaggcaaaatctcttctgcatgatgggtcgtgtaaagcaaagtaggcgcatcaggctttgaagcaatgaatgagatggtctctagcacctgttctcttgctaaaaaatcaagaccggtcacaggctcatctaaaatcaggagcttaggatcattcattaaagccctcgcaatcaggactttctgcttttctccttgtgagagtgtttcatatgtccggttcgcatatttgaacgaaccaaatgcttttaatagatcaatggctttctctcttatctcatctgtcggggtttcataaagcccgatggaggcaaatgccccgctgataacaatttcaaatgcattgtcgtctctgtgcagtttcttttcaagtcccgcagaaatgaggccaattttcttcctgagcttttcgccaagagcctccttgccaaagacatgtcccagcaccgtcatctcacctgatgtagggaaataatatgagcagagcatatttaataaagcggttttccccgcaccatttaaaccataaagcacccagtgctcctctttggtcacctgccagtcaacagactgaagcaaccattttccatttcgttttaaagaaacattctttaattcaagtgacaccatcatttcctcctgagtaaaaattctgaataaacaaataatgaatgtttacagcatatcgcaattgctctttctggtaaacctcatataaaaaagctgctccttttgaggaacagcttttctttaacgttacgaaatttcaattcgtacgccttcttttatatcaggaaacgtgtgcggagatgcaaagacagctcccggtaatacatcatcaaacggctcttggaagtagatcgaaatatggccgagctctttaaagttgtcatttgctttattgccgagggctgtgatcgtgtacgtttgatcacccacttgaatggtaccgcccagtttcaacggctcttcttctaaatgttcgaactcatgaatgacggacatatctcttaattcctgcggcgctgcgggtccaaataaaacaatcagcttatcttctttaaattgcgggactaaaatcccgatttcttttacgacagattgtgtgaccatgtatctcgattcctcctttaatacgtttaatacataccaaagctggcagcgtatgcgatcacaacagatagaacccctgtaatgagacggctatacaaaacagctggtactccatattgtaccgtttccggcttcgcttcaccaagtgatagcccaactggaatgaaatcacaccctacttgaccgttgatggcaaatagtgcaggaagtgcaaattgaggcgggatattccctagtgcaatttgactaccaatgagaacaccaattacttgtgcaatgactgcaccaggtcctaagacaggtgataggaatggcaatgtacaaaccacaacgaggagtaagagtccccatatagatcctgccagtggtgatagaaaatgggcaatcaagtcaccaatttttgtataattgataattccaattaacatactgacaaatgccatgaatggaataatgtttttcaaaagcatatcaacggaatcacgaccagcctgatagaacgtaccggtgactttcccaattcctcttgagaacctcatcaagaaattacctttttcctgacgctcgagattttcctctttcagttttgaataggtttctttgaaattctctttgtcaatcggctcactgttaccctgaccttctgctgttgcctcaccacttgatgcatccgcaaaggaaatatctttttctgtgacgcctgatacgaagatatcctctgtaatatgttttgcaagcggtccagaaggagaggatgccaaaacgtctacagttggaatgcgcttcattggataaagtccgattcgcgcggttcctccgcagtcaatgacaacacacatcatttcatcttctggtatcgagtttttaaagccatcacatgcttctgtccctgtcatttctgcaattttacgtgcaactgggtgaatgcctccccctgtaatggaaacaacctttctttttttaccggttggttcaagctccaagccttggccccatccgccagcaccttttgctacaaatactttgtggtttgtcatgtctaaccctcccctattgtgaattcgctttcatttttcctgctaagtactttgtaatccattcagtaataataccgcgaagtaaaatgacgacgatcccgactaagaagtaccgaacagcaagctctgacatagagtaccctgcttctttaatcccgttcgcaatccctaagtagacaaacagttctcctgcgttggcatatgggaacagtgatgtcaccggatgaacaaatgaaacagctgaatcatagaatgctggtttttgtttttcgggtaagaatcggccaaacgtataagccattgggtttgtcaaaataagaacggataagatcggcattaacgtgtagcgcaaaatggtatatttcgcagcaaactgaattgctctattcactcgctcttctccaataaacttcatgacagcataagtgaaagtaagtaacacaacaagcgttggaacgatacctgtaacaagacccatgaattgctttccgccggcttcaaacattccgataaagtgctctccaaaccattgaatccattccatgtttcatctcccctttctttagttcacatttgttatattttttttcgaaatcgagacaagtgcctgttcagccgccatggaaagtgcgtgcatgacagctggcccctttttgcgttttttcaacgtctgcttcatcatatggtgctcgtctaacactgcccctacatgctttccttcatatgaagggacttctttaaatttagataagatcgacacaccgccaagcacatggcatttttgaatgatatacgattcatctacaatgatgagcgcaatggccccagggccaactttgcgccgctccattcccgaaaataagtggtagccctgcttccctctgtaatcatcaataagtgaatccatgctcttgcggtagtacttgatttgaataaaagataacccatactgcacaatgagaatgatacaaagtacgatcgctaatttttccacagcttcacgcccttatgattgaaataaatgatcttgtaatgaacgcagcttccagaccgttgtgtttgaatcaagctctacatcatcgtgagttaggaattgtcctaatttgatgtcttttttcgctacgacttttccgctaattaagccaattggaatgtggccgttcgttttcatatcttgatgtgtttcaagaacacctcttactgagtatccaccaattccgtcaagtgattctccagctttaatatctcttttcgccacagcgactgtttctgacactggtacaccaattgggtgaatagatgaatcatgctgtaagaccgcttttgcgatggtaacaggtgtttcaagactcgctaagtggaaaggacggtaaagtgtgtagtgtgggccttttccaacttttaagtagcgcagctcttcatctactggctcaaggtcactcttcacgatgacaaatacacctggtgcaagtccatttacatattcaacgaccccgaagttatcgagcacgccgccttgctgtttttgattcaatttatctgcaacattttctaaattcgcttcgactccatgcataccgactttatctggcagaagccctgtcgcgttacttaataagttcatttccgccattgtttttgttccgtcttggaatgcagccagcatatgtgcactcatatgtttactatctgcttctgctttacacgtatctggatttgcctctgggaagaatgggttgttctttcctttcccagcaacgagtacttcaagccccattgttttcgcaaattcatataattctagtgttgctgctggttcatctccagctgatcctgagtaaacaagtcctgcatttgtgaacaacttatgcatgaccaatccgatggtaatatcaacttctacatttaaaagaacaagatgtttttttgaattaagcgcttccaaagaaatgtttgctccgacctctgggactcctgttgcatctacgacaacttccacggaatctgattgaatcacttctctgtaatcatttgtgacaaccatttgatgcggctttgcatgctgcttgtaaaaattcgctgccttctctgctgcactaaggtggatatcacaaacaccagcaacaatcatgcctggaattttagaaatttgtgaaatgagtccaaagcccatttggcctgccccaataatccctactttgattggatccccactacgttctcgcgctaacaattgttgatagattgacatctaaatcatcctttcaggttttcttgcttctcgggtagattgctagaaatataatctgaaacttttaacaaatgttataaaaattaacaaaaatctgtttcttgtaacatttgttattttatttatcatttgttatgaacttagtttatatgatgtgtcaactttgtgtcaagctaaaatcgataaaattttcaatctttttgagtctaaagactcaaaaaaaaaactacctaatatcattaggtagttactttaataaggcatctccagttcgttcatcggtaattaatacatgaattaatccacctgctaatgccgcctgaattgcttcaattttctcttcaccgccagcgacacctatgactagcggaatttctttcagcttttgcgggcttatccccatcacccggtcgttccatggatggggatatacttccccttgatgatcaataaagttatagcaaatgtcacctgctacatcctttgcttgaaggatgtcctcttcgccgcttgtcatataagatttcaccatcgttgaatgctgcggaacaccaccaattccgacaaccgcgatatttgatgattctcctagttcaatcacttttttgattgacggctgccggatcaggacatctttcgcttctttcgtatcaagcatgacgggtacatgtaaaaactcacatttagatttgagtgcctcagtgcatctcgcaataatatagttggcgtggatatcgacatcttcatttcccacacctccgacaagcggaacaaatgtcacggatggatagtgctgaacagacgtaagcgctttcgccatttcatgcagcgttgtccctgaggaaaaaccgatgacttgtccatctttcatcacttttaataaaaagcttgccgccgcggctccgattcggcttttggttgtgtctttgctgagtgtttccacacagacaacttctcgcagcccatatttgcgttctatttttctttctaacgatccatactgttggttgacttcatcatgaataatgatttccacgattcctgcttcacgtgcttttgccaaatatttcgatatgagcgaacgactaacccccaccgcttctgcgatgttagattgagtggcgccttcttcataatacatatgcgcaaccttaatgagcagccttctttcatcatggaatgtcataataacccttctttccgcttaagtgttccctaacaaatgctatctaaaataacatttgttaaaaacagattaaatgaaaaaaataacagagtcaatactagaggcgtgttctctcataagaatgaaaaaagccgcacatgaagcggcggctttaaaagatgtttttattcatttgtttaatggctgctttttcaagcctcgagacttgtgcttgagaaatcccgatctcctcagcgacttccatttgcgttttgccttggaaaaagcgttttcgaagaatcattttttccctgtcgttcaatctgcgcatgccctcttttaaggccaattcttccacccattgtgtgtctttgttccgttcatcactaatttgatccatcacataaatcggatctcctccgtcattatagatcggttcaaacaaagagacaggatcttgaatcgcatctagggcaaaaacaatttcctcatgaggcacttccagcactttggcaatgtcttctgcagttggctccttgcttgtctcactaatcagcctctcacggacctgaagtgccttataggcaatatctcttagtgagcgagacacccgaatcgggttgttatcacgcaagtatcgacggatttctcctatgatcataggaaccgcataagttgaaaatctgacattgtggcttaaatcaaaattatcaattgatttcattaatccgatacagcctacttggaagagatcgtcgacatattcgcctctgttgttaaaacgctgaatcacacttaaaaccaaccgtaaattgccattgactagcttttctcttgctgtatcgtcaccctcatcttgcaactgtctgaacaattttctcatctcgtcgtttttcagaacaggcagcttggaggtgtcgactccgcagatttccactttatttctggacacttttttccctccctacaggagctgttgtacaaagttcagtatctccttgggatggaaaaatatgcacgagcgatgacgagaatcatgagaaaaaaggttatttcctttgacagtgcagggacagagcttttttttaaaaattttttagaccattttattaaattctttttgtaatcgtttaatgattcgtttttcaagtctcgaaatataagactgggaaatcccaagcatgtcagcgacatctttttgggttttttcctcgccgccaactaagccaaatcttagttccatgatctgcttttcgcggtcatttaattgctctagcgcttttttcagcaattttttatctacatttgcttcgatatcccgcgtgataatatcatcatctgttccaagtacgtctgataaaagcagttcatttccgtcccaatcaatgttgagcggctcatcaaacgaaacttctgaccggattttattatttcggcgcaagtacatcaaaatctcattttcaatacatctcgacgcatatgttgccagcttgatctttttttctgggttaaatgtattgactgctttgatcagaccaatggttccgatactaattaaatcctcaatattaataccagtgttttcaaattttcttgcgatgtaaacgactaaacgcaaatttctttcaatcaaaatcgctcttgcggtttgatctccctttggtaatttgacaagcagctcctgctcttcatcctttgataatggaggcggcagcgcttcacttccaccaatataataaatttcatcactctttagacctagcttcatgaggagtttataccagtagtaagtgagtttaaattttaattttttcatcttcttctcccttctaaatgtcaagttgacctcgtaagataaaagacatcaccaaaaactacgacaccccttggatgattttcccgtctaacatatctggatgaatgatggattcaaattcctgatctgccgataaaccgctcagactcaaccctacaaaacacttagcaggctgaatcatatgcgtctttgaataaatgaagactgtatctggttttaggcatagcagaaagccatgatcatgaccgactgctcgatatggaacaagtcttaatcgatcaagaagaggaaattgatcatcgatcttttgcatgacttcaacaggatgagactgtttcatgagctctataaatggctctccgcaaatggctgttagctggtcagcctggacgatcatgaccggtgtttttgtcataggatcatacagctggttgccagaatcgacgagtccctttaaacgaatggtttctccatgaatgtgtagttccacaagcacttgttcatcatactgtctttttttcgtaccaacctctcctaatcttttctttgaaaacagccaaatcgcaggaaacccagttaaaacaaaaagccagctaatcggatcaccaaagccatcattttgtgaaatcagcagaccattttgaatcactgtattggtttgcaaaaatgaatgaaccccgatcatgcctcctcccatcaaaaaagttacaaagtaaaaagcaaacagattttgaaaaaaggaacgaaatctttgaaaaccaaaggttgcaagaacgatgaagatagaaaaaagtagtttgcctaaagggtgtgacacaaccattgcaaatggtgtaaagagcaagagaacaatgctcgatccaatgagcgctcctaacatatatcgccttttttttacttgtcgtttgagaataaatgcagtgagtaagagaagcaatagatcaaaacaaaagtttaacagccaaatcacatctaaataaatgaccaccttctgctcctttcatctgaaacaaagaatcaaaagcagtacttgcacttgtttgtaccagtataaaacagtcatgagatggaagtctgtcaattcttgttggggatgatagagaacttttggtggattgttattgtttttgtcgaggaatgagagagagtattcttctggacaagccatcaacaattgtttgaaagaaaaaagacacgctcctagaagtcgtgtcttttgtttatattatttttcattgatgtttaatgtacctgaagctttttgtcttgtgacatttccataatcatctcgcacaatgacttctacgaccgcaccttttgctttagcggtagaagttgcagtccagtaaccttcatacgttccgctcgatacttcgcgaagcggcagctctgtagtattttgaagctttgatctcgcgtttgtcagcggcatgtgaatgacaaacgttgcgtctagcttttctctactatgaaatgaaatcttaacagactcccctgatgccagatggacattatctgctggagtcagcttagaaatctcaggtgcatcgtattgaacatcgatattgatttttttagtcgttttgtttcctgctgcatctttcgctgtgactttgatcgcattttccccgttctcaagcagtattcttgcggaatacttcccttcttttatggttgccttttttccatttacagtgacttgatcaagatgatcatctatgacctttccttctacagtgaacgattctttatttgtcttttccccttttttcggtgtatcgatagtgagcagtggagctgtttgatcaatgatcagatttactggtttggatcgttttgttgcgcctttatccgtaacagttgcagcagtgaatacatgctctccgcttgatactgtgaccttttctttaaaagcgcctgactgatctgctttcactttggcaatctcttcatcgttttgatagatcgctacatcaagcccaggagaggctttgccttcaatttctagttcatctttgttcgtaatgattcctgcctttggagatgtaatctctggcacatctgcttcatagtcaacaagcgcacgaatcatataattcccctcttcttttggagaaggagaaaaagcaccgcttgtcaactgccagcttctttcagcatttggtccatcctcatcagttgcaaggcctggagattccgtattctttttcgtttgaatatagacaagatagaaatctccatccactgtaatggcttgatcttctaaatctacttttgtccattccccattacgcagcgcattcgctttgagcggtcctgcaattttctcccctggagctccgttcttcccagaagcgtcatacacttcaaccgcaaagtcattccctccaggagctggccactctgatgaccagaaacggaaaagccctcctgtgagttgcgcttgtttcttccccttttctaatgaaaacttcacagcccagccattaccaggatcatagaaagctctcgcattttcagctgttccgtcatcgtagccaatttccccagcaaagccgatgaatggttctagctgaatggctttttccaccggcttttctgtcacatctgctgtaaaagaatatcctttaaaccctttggcaaatactttgacggtatagacaccgcttaatgcctctagagaaaattcaccagattcatttgttttcaccggcttaattttcgcatcctctacaaggtaaaccgtggcatcctttactttttcacccgttgtttcattggcaattgtgccagatatcgttcgtttctttagtggctgtaaggcgaaattcgcctctgctgtttcttttgaagaaatatggacggtttgtgtgcgtgattcaaatccgtaagcttcggctttcactgtgaattctcctgcactgtgaggaagctgatatctccctgttgcttcatctgtgtacgttgacttgccgctttcaagaacactgatttccgctttcataggaagagctttgatggacggagaagctagatttttttcctttttcttttcttttatgttcgcaggcttcttatatggatgtacagccttatcttttttaggcatggcttgatctggtattttcatctcatctaaatgaacatcttcgtttgtcacctgtccttcaatcatgccaattccatctgttaatgccgtaattgctgctcttgcatcaactaaacctgccccatagccattgtttggtgactccgggaattgctgatcagttaacggcttcgcagtatcaatcagtatttgttcaatctcttcaacagaaagatctgactgtacttggcgaagaagagccacaacagctgaaacatgcggaccagccatcgacgtcccattccagccatcctcataccctttcccaggaatggatgaacgaatgtttacccctggggccgcaatgtctggtttcatgacaccatatggagacggaccttgcagtgagaaagaccccaatttgttattttgatccgtagcacccgttgcaaaggcctcttgatagttcgcaggattcgcaatggatccttcaccaccagggttgaatagatcggtattgcctgctgaaaactctgggaagatgtccgccgctctccaagcattgacgacatctttataccaatcatcaataccaggcccaccgccccaagaattattgacgacatctggtgccttttctggatgcgggtttcccgcgtcatcttttggtgctaaaatccactcacctgcatcaagcagatcagcatctgtaccaccatcttctgagaaagctttcaccgcaatccattttgctcccggtgcgactccgatttgattctttccatctggctcagagccaaccatcgttcccgttacatgtgtaccatgctctaaatcatcatatggcgcttcagatcctgtcgtagcatcgtaccaattgaattcatgagttggtccattcggatgtgctggatcaaatccgcggtatttttcctttaaagcaggatgttcccattccgctcctgtatcaatacttgccacaactgtaccagtaccgtcataacctaaagcccacgcttctggagcatgaacttgagaaatgttccactcgaccccatctactgctttcatttgttttttctgcttcgtcttcaaatcaaccggccggtgaatttgacgggtttcgtttggcagcacttgatctacttctgggaaggcagccacctgttccataacttctttcgttcctgtcaccgctaaaccattcacaatatagtacgaatgaatctccttcacttgctttttcttttgttctttttgtaaatacgtaagaagcgcttgctgcgtctcctcagacgttgctcttaattcagatacgacagctgatcttttggcgtattgcgttttagccgctgttaatttctgttttttggctttggataccgcttccttcgccactttttgagtatttgtttgttctttcattttgattaaaaatgtcacctgatcatcctgctgaaactgtttcattaatctagatgagatctttgcttttgttgtcttagaggagacagcttcctcctgatatgaggtagaagtcgattttgcttgaaccatcccaaagcttgtcatcgttaaagtaccaatcaccaaaagactcatcaaacgatagccggcggtcttgcgaaacttcaatttcaatcaaatccctcctcctcaaatggccaaacagagtataggtctcactcctttccttctgttgttcatgacaagattcatggtgttctatttaatgtagtcaaataaagttcatcattttgtcgttttttgtaagagtgagtgaaaatgattcttttttcttaaataccataagtcaaattacatatggaaattgaagtgactttcactcatttaagactttttgattagatcctcttatacgttgaaacatgaaaaaaccccttccaatggaaggggttaagcgatactcgattagcgtttattgcggttgcgtaagaacgttggaatgtctagcgtatcatcacttgattgtgtattttgtcttggctgagatgatggctgttgatgttcctcacgtttcacttcacgtttttgaggaatggattgattttgctttaatccttgtcctaatgggtttctttgtgattttgtcacttctggttcttgctcaatgaatccagtagcgatcacagtcaccacaatttcatccttcaagttatcgttgatgacagacccgaaaatcatgtttacatcttcgtcagatgcagaagccacaatatccgctgcttcttgcacttcataaagacttaggtttgtaccacccgtaatgttcatgatgacaccttgagcaccatcgatcgctgtttctagaagtggtgaagaaatggctttcttcgcggcttccgcagcacgattttcgcctgttgcgacgccaatacccattagagccgaacctttattggacatgatggttttcacgtcagcaaagtcaaggttaatcagacctggtgttgcaattaaatcggaaatcccttgaacaccttgtctaagaacgttatctgccgcgcggaatgcttccagcattggcgtgtttttatcaacaatttcaagcaagcgatcgtttggaatcacaattaatgtgtcaactgcttctttcatagaagcaattccttcaactgcttgaagctgacgttttcttccttcaaatgtgaaaggacgagtcacaactccaactgtcaatgcaccagaatcttttgcgatttttgcaatgacaggtgcagcacccgtaccagttccaccgcccataccagctgtaacgaagaccatgtctgcgccttttaatacttcttcaatctgctctttgctttcctcagcagcttttttaccgacttcaggattcgcacctgctccaagccctcttgtcagcttagcaccgatttgcattttagtttctgcttttgatagatttaatgcctgtgcatcagtattgactgcaataaaatcgacaccttgtacgtcattttcaatcattcggttgacagcgttattcccgccgccacctactccgattactttaattgatgctaggccgtctatatttgtttcaaactccaacatgctgaatcctcctaatccgtcgaaaatctaattctattcccagaacatattaaatagttttttcattttgcccggttttttatttgtctcttgttgtgctttttgttttactttcggtcttggctgcgcttctttcacttgtggtgcagaagaaaccggctccatggatgcgcctacttcatgaaacgcctcatctggcatttggaatccaacctgtctgccctgaatctttgcattgcgataagcaaagtggatcagacctactcctgtcatatattgaggctctctcaccccgatataattcggacttgcaatcctaacattgttttgcaaaaccgtctgtgcaagagaaaggatacctggaatggctgcttgtccacctgttagaacgaatccaccaggcaaatcatggacacccatatttcttaattcctctgccacaaagagcaagatttcctccagccgcgcttcaattatgttagccgcatcaagctgtgtatacgtttgtttttgatcggtaccgatcacagaaacttcaaatgtctcctcagtcgatgcctcatcataaaacgcatgcccaaattgttttttgattcgttcagcttcttcagtggaagttctaagtcctatagacaaatcttttgttatgttctctccgcccaaagggatactgtgagtagaatagagatgcccgttttcaaatacggaaatcgttgtagaaccgccaccaatatcgacaagagctactccgagatttttttcatctttcgataatgctgctgagcccgatgcgagtggctgcaagcatatatccattatttcaattccagctctttctacacatcggagccagttatgtagaatcgttttagaacctgtaattaacgatccttccacttctagccgaacaccaagcatttttttcggatctgtgatctcatctcttccgtcgacgataaattgtctcggaatcacgtctacgacgagatgttcttgaggaatagatactacttgtgcagcatctaagacacgtctcacatcttcagcatgtatttctttgttttcactagatactgcgactacgccgctcgtattctgaatatgaatgtggtttccgttaattccgacaatcgccttttgtaaaggaaaacctaccattctctcagcctgttcaaatgcttgtctaatagaatgaactgtctcatctatatcaacaatcgatcctttttttaacccctctgaagggacatttccaacacctataatgttaagcgaatcatccgccatttctccgacgatgacttttatattggatgtaccgatgtcaaggctgacgtaaatttcattgttgttcattctatggcacctcctcacatatcaatactttctattctattatttgctgaacaacaatacaatgaatgtgtttttacaagtgtgtaacaaaacttaaaaaatcaacattttttattaggattactgaaaatattcgttacatcatatgtatatccttttttatgactcactttttttctttttttctctagaaattgtccattttgttagtagaattcttctgataactgctatattttgaaacaatctaacgccgaatgcaaacattccgactaagtacaagtctacaccaagatggacgcccagaaaagctaaacttattgccagtataatattaaagaagaagcctgatacaaacactagttcatcgtatgccccttgcagatgtgcccggattccaccaatcaatgtatcaagcgcagcaagtacagcgagggaaagataattagaatactcattcggtatcgtaaaattagttaagaaaccgatcgcaactcctatgattaagccaagtacaggtagccacattaagattttccctcctttacatcgtcaagaggcttcaattcgtttacttgaattgcaccgtcatatgcttttaagtggatttttttcttcggctggctcattctcaagctgaagttttcctgagcaaacaaatcaccaatatctgatacatttaaacggctgtataatttgtcggcctgctcactaatcattttaatgatgacttcatcactatctaagctgaagccatccatttttgttgtgccattaatatctcgaatgacacttgtattaatgacacggcgatcattgatggaaatatgttttgccccaaacatattggcttcattaattaattttttcagaagatcaggtgggatgtttttcacttcttctccggtaaggtccttggaaaaaagctgagatatttcaatttcaatcccctccccttccacttctgtaaaaccagccttttcttttaaatcttttaacgtttttgttaattgagcttcttttgatcgatctccttgatgaccatatttttttagcatctcgtcatatttatcaatttctttcagcaaatccaattccttacttttagatgcggataaatcctctctcagttcccacacatcacgagtatctcgaactttgggcttttgtaaggaattaaattggatggagaccatgatgccaaatatgatcattaaagctgttaaactaagtaaaggcttctttttcctcaacaccactcaccttttcacttttaatctttgtttcttaaaagagggttcatacgaatatccgttttctcaatcgtcattgaaatgtgatcacttgtcagctgatcgaccactccccctgcaatatttaaagcaggtattaacacagctggatcaccaatagcagatatgacaaatggtgctggatgctgaacaccatctactgtgacaactggaccgttacaatgtatgtatgattggtgtgtgattctttgtccattaatagatacagcagaagcacctgatataaatagttcgtttatcacatgaaaaatatggctctcatgcacaatgtaattattgacattttgtccactcgggatataagatgcatcttcaagagacacttttaccccttttccttttacaccgatctctcctgtaaacattctgtatttctcaacatcttccagtacattaaaatactgctctttttcatttttcaaattggactctgttgcttgtacctttgattgaagactatataattctttttcgagtttctgattcgccttttcttgcgttgtgagctgacttttcagggagtattcttttttccattgctctgtccgaatgacatctgcctgatgctgctttgtatattggtatgaaaaagatatcagaaaaccaagaacaagcatgacaagtgagaatataactgttttgcccctcaacgctcatcttcctttttcttagatttaaacgcttcgaaatacgtagcgacttccatatgaattgtgcctttttcagatggcgaaagctcttttacaatggctggataggttttcattttatcaccgaatgttttaattgaagcaatcacagtgtttccgtcattcatataaaatttcactagccacttgtttgaattggtcggcacataatatacttctgagatgagttcctgaatagaggctggcagctgatttaaagatttaacggtttgcttcagcttctccttattgtcccaatcaacaaaaataggtcctgcatgactcggtgtcacttcttctggtaaagcggtcccattttcaagaagctcataatatagatttcccttttgaagatacgcaatatttgcatattctttgacagtaatacttactttatttgggaaatgctttttgatactgacacttttaatcaatttattttgcttcatatgatctgctgttaaatctttatttaaattccaaaactctgtttcgccttctttaatttgtgaaagtttaacaagctgttttgttgagacatgttcgttacctgtgatggttaaagaagatatcttgctgataggtgtctgcaaataaacaataattaaaaccatgataaaaaacagtagtataaaagagatcagtctccgattcgctttttgcttcctttgttctttaattttaggaattcgctcttctatattgacgatcttttcattttcatgatcaggccgcatatatactcttcacctcattcaaagctgcttgtccacacctttgggtcatcattttgatgagaaaacaaacggcatgaaagaatgccgtttgttttcctctgatgtcatcattcataaaaactacctattaattttcttcaccgataatttctacttctgtatgcatctctacgttgtagtcttctttaattttcttttggatgaactgaattaagtccagcacgtcttgagcagtggctccaccagcattgacaataaagttgccgtgcatatcagaaattctagctccgccgatttggtatccttttaaattcgctttttctacaagctgtcctgcatattcaggcagcggatttcgaaaaatactgccagcacacggccgattataaggctgagtttctttgcgataatctttattttgctgcatcttctttgtgattttctcgcggtcatcctgcttaagcttaaacacagcttctagaacaatgccaggtcgttccttttgtaggactgatgtccgatagctaaaattcatttgttcatttgtaagccactcaatgcttccatcttcaaataagattctagctttcacaagaatcttactgatatcagatccatgtgcacctgcgttcatataaacagctccgccaatagatcccggaataccagctgcgaattccagtcctgaaagaccttgtttactaagtgatgttgcgagccttacgacagagtagccgccgccgactgtaatttcttcatcatttacagttaggtgatccagtccagcacccagctttaggacaactcctcgaattcctttatcgagtacaagtaaattcgaccctcttccaataaccgtccaattcgtatggtgttttttcacatgatccatgatcgttttcactgcatcgatatcttttgggatgatcaaaagatctgctggtccgcctattttcattgttgtatgattcgcaagcggctcattttcaagtactttaccaacttgcgcttctaataattcattcttcaagttctccatattaccctccgccttacctaatatcattccatcatgtagtcgtaatttcttttaacacattatataaacgtgtagccgcatctggtactcctagttctttcgttaaacggctcatttgattgagtttttcttcattaccagcaatttcatcaatggcatgaagcagacgatcccctgaaagctctgattctcttaaaacaatcgcagcctcatgtttttcaagtgatcttgcattgatttcctgatgatttgccgtcacgtatgggctcggaataaaaatggttgggattccaagagccgttacttcagcaattgttgtagctcctgctcttgcaacaatcacatcgatcgatttcaggtactctggcatttgatgcaagaaaggttttgtgatcatgttaggtgctgcacctttttcctttagttcattcaacactttttcataatgaacctcacctgtgatatataaaagctggtagtttttagcctttaaatcatcttgcatttcgatcactgctctattgataggagcagcacctcgactccctccgaaaataagaaccgtttttttcttttcatcgagcccgaattctttaagagatttcccctcttttatagagacgacttcagaggctctagggtttcccgtaaatacaaccttttcagaaggaaaatgtgcctttgcttcatcaaagcatatggctaccctattaacatatctcgctaggaacttatttgtaataccaggcaggctgttttgttcgtgtataatagttgggatcttcagcttagaagccgcataaaccacaggcccacacacataaccgcctgttccaataaccgcatcaggcttgaattcttttaagtaagatttgcttttttgaacgcctttcaaaaatctcatcaccgttttgacgttatcaaaggaaagctttcgtttaaaacctgaaatttctatcgccttgaaagggatattttctctttctacaattttcttttcaagtccattttcagtaccgatatataaaaattccacatcaggatgtagtcttttcacttctttaataaaggctaaggccggataaatatgaccgcctgttccgcctccactgattactatacgcattataccatttcccctcattttttttctgctctgaacaaagtataaaccctgttttaaacaacagggctccattaaaacctgtaaagaagagtcaaaatacacgttttctaaacaaaaactgtcattttcactcttcaaatcatttttttatacttttgcaaaataaatgtcaacatggtttcattagcttcagcacgctaatatcttgcgtacctgcttacattcagaagtacaccaatcgccatcagcattaatgtcaatgatgagccgccataactaaggaatgggagcgtgatacctgtcacaggaataagtccagtgacaactgcgatgttaatcattacttgaatggcaaccattgaaataataccaactgctaggaaactcccatataagtctggagctccaagtgctattcgtatgcctctccataatagaacactaaagaggagcaaaatgagtgatccccctataaagccaagctcttcagacaatatcgcaaagataaagtccgtttggggctcaggtaaatagaagaatttttgtctactttgaccaagtcccattccgaacagaccacctggaccaacagcgtataaggattgaataatttgaaacccactgcctagtggatcttcccaaggatttaaataagatgtaattcgttttattcggtagggtgctgataagacaagtgcagcaaacccgctgagccctataaggccgagaaatataaagtgagcaattctcgcacctgaaacaaatatcataataatacaggttccaaccattaccgttcctgttcccagatccggttgaagcataatgatggcaaatgcagaaaatacaatgcctaaagctggggcaaaacctttgcgaaaggatgtgatatttttttgtttttcagataagaattttgcaagaaacgcaatcatcgcaagcttcataaattcagagggctgaatactaaacgcaccgacaccgatccagcttcttgatccatttctctccatcccgatgccaggaataagtacaagcagcaaaaggagaaaacaaacagcaatcaatatctttgaccaagtccgccacgtccaataatcgactcgcataatgaaaaacattgcgataactccgattccggcaaacaaaagctgtctttttgcaaaataaaacgaatcatcaaatttatacgatgcccacacagcactagcgctgtacaccataattaaaccaatcgtcaataaaagtaacgtaatgacaacaagcaaaaaatccggagaagttttcttattcgtcaagagaccgacaccccaagcataatttcatttgggctgtcagtcatatgagagacaagcccttatttaagcatatgcacggcgtttacaaacatgtctccacgttcttcaaatgttttatgttgatcccagcttgcacaagctggagataataaaatcacgtcttcttcttcagatatgttaaacgccgcaggtactgcttgttcaacattatcgacatgttttacgtgatgtattccaagctcttcaccaagcttcacaaacttaggtgcagtctcaccaaatgtgataattccttttacatgtttcataaaaggtttcaactcatcaaattcattacctcgatcaagtccacctgctaataaaatagtcggttgttcgaaggctgacaatgctttacttgttgccaaaatattagttgctttactatcgttataaaatttacgactctgaattgtatctacaaattgaagacgatgcttcactccaccaaatgtcgtgagaacgtgaacgattgcttcatttgagcagcctgcattttttacaacacaaatagctgccagaatgttttcttgattatgctcaccaggaaggacaacatcttttacatcaatgatatgttcattcatgtagtaaattgcaccatgttgaataaacgcaccatgttttactggctctttcactgagaaaaacactttttttgcttttgaaccttctgctagttttacaacggaaggatcatctaggttaattacagcgatgtcatcttcctgttgatgtgcgaatactttctgctttgctttttcatattcatcacgagtgtggtgataatctaaatgtgcatcaaaaatatttaatattaagctgattttaggtctaaattcaactgttcccattaactgaaaagaagagagttctgttacgatccactcatcgccagctgcatttgcagcgacttcacaagcaactgttccaatattacccgccactaatgttttttggctgtcttgtttcagcatttcataaatcaatgtcgtggtagtggtttttccattcgatccagtaatcccaataaaaggagatgaggttaaatgataagctaattctatttccgtccaaactggaatttggcggcgaagcgcttcttgaaccatcacattttcatatggaatgcctggatttttaattaaaattgtaatgtctttatcttcgaatatacgaagaggatgactgccacaaatgacatcaatccccttttcagaaagtagctgagcaggttcattttcttcaaacggtttttgatcatttaccgtcacatttactccatgttcatgaagaattgaagccgccgcatatccgcttttagcaagacctaatactagtacatgttcattttttaacatttgcatcttattcaattataaccacacctcgatgtaaattcctaaaacagcaagtaataaaccagctgtccagaaggtgacaactactctccactctgaccagccaactaactcatagtggtggtgaagcggactcatcttaaagattcttttgccggttgttttaaaggagatgacttgaagaataacggataacgtctcaacaacaaatactccaccaataatgacaagtaaaatttcaagcttcgttaaaatcgcaattgctacaatggctccgcctaatgctagagaacctgtatcccccataaatacttttgcaggatgtgcgttaaacacaaggaagccaaggacggctcctgcaacagctactgaaaagatcgctacatcatactgagattgattccaagccagtatagcaaatgctccgaaagcaatagcagcggttccagataagagaccatccagtccatccgttaaattcacagcattagaacctccgacaagcatgaaaacaacaaggataaagtaagcccatcctaaatcaaagctgacgtctgttcctggaatgcgaatcgtcgttgcaaactgataataatggaaaactgcataaaagatcacagcgatcacaatttgaccgattaatttctgtttcgatgttaaaccaagatttcgtttcatcgctactttaatataatcatctaaaaatcctaataggccgtaaccaagtgtgacaaataacagtaaaaacatttctggactaatctcagaaaatttgttgatcatcacaatcgttgtaatagtaatagaaaagataatcatgatgccgcccattgtcggcgtcccagatttcttttggtgagactgcggaccttcttctctaatactttgaccaaatttaagtcttcttaaaaacggtataaaaatcggggataaaagaacactgattaaaaatcccattatgattgtaaacaatatcacctgttcaagcatcgttctttactccttccgaatttccaaagccgttttccaacaaaaaattgcattcattattatggtattcattctcgttcttcatatgttgtttttgtacaaaatgcttcatttcattacactcttttcatcattttaagatttgtttagatctaaaatagcgtcaacagcaacctttgcatcatcaaagtcatagacttgatcgccaataatttgataggtctcatgacctttacccgctattaagactgtatcgccttttttcgcattggcaatggcaaaaaagatcgcttgtttccgattcacaaagctatgataatacgcgtctgggaccccattttccatatcttttaaaatggctgaaggatcttcgcttcttgggttgtctgatgtaaatacaggttcatctgcatatttcacagcgatttgagccatttgaggacgctttgttttatcacgatcgccaccgcagccaatcacacagaaaattttcccctctgttaattctctacacgttgtgaggacattctctaaactgtcaggtgtatgcgcgtaatcgacgatgaccgggaaatcttgatcgcagtttacaagttcaaatctgcctttgactccttccagctcttcaatcgcactcacgatcgtctcaaatgttaagccagatacgatgccaactgatacagctgcaaggatattatacacattgaactttccgacgagggcaaccgtcacttttttggtgccgattggagtgaccagatcaaactgagttcccttcggcatgatttgaatattttttgccatgacatccgctttttgctctaaggcatacgtcatgacttcagcagctgtgactttttcaaaataactcgaagcctcatcatctgcatttaaaatcgcatgcttcggtttattgtgatgaaaggcacttccaagctgagaaaacagcaagcttttcgcatgtttatattcttccattgtgttgtggtagtcaagatggtcctgcgtaaggtttgtgaaaacagcaatatcataatcacatccatgtactctgccaagatggagtgcatgtgatgatacttccatgatggctgtgtctacatcttgatcaagcatctgtttaaacgttttctgaagtgtgacactttcaggtgtggtgtttttcacgtcgagaatgtcatcattcaccttcatatacatcgtaccgattaagcctgttttcttctcggcttttctcatcatttgttcgatcatgtgtgttgttgaggtttttccatttgtgcctgtgatccctatgagattcagcttatgagtgggctgttcataaaacgcatcagctattcttgctagtgctctttgagagtgtttcacaataatgactggtacacctgttatgttaagagggtgttctgctacaatggctacagccccacttttcaccgctttttcagcataatcgtgtccatctactgtatagccttttatacagacaaaaaggcttccctctttcacctctcttgaatccatttcaatggaagtgatatcaggattttcgtttatcaattcgttgttttcaattttaaagtatgtaagcagttcttgtaatttcattttcatatcaaacctctcaaattcgttcacgtgcatgtcttgtgaaaaaaacacacagtctatattttatcgtaaaaaaaaggatacatccagcgtattccttaagtttctgttggaaaaaacacactttggactctttttttcaaactgtccttctctttcaacaaaaagaggcagccaaatgagtgcggctaccctctgttcattctttattattcatcgtttaagtataatctgatcgtggaaccttctttgacttttgtcccagcagcaggtgattgcttcactactttactgccagttcctgaggcatcgatctttaggttgatcaagagggattcaagatctgaaacagatcctcctacaagattcggtacttcaatggtttttgtgtccagccactgatacttcttttcaatttggccttttctttttttcacacccatctcaggcaggctatcccgcataatatgaccaacaattggtgcggcaacggtaccaccaaattgaatggtgccttttgggttatccacagctacatagactacaatactcgggtcatctgcaggcgcaaatccgataaacgacacaatgtggttattctccatatactttccgtcctttaccttctgtgctgttcctgtttttccgccgacccgatacccttcaacaaatgcatttcggccagttccttgggcgactacactttcaagtgcatacctgatttctttagatgtttctgctgatatcactttctttttggcaatcggcgattgctttttcacgacctcttttgtgattggatctatccattcttttgcaatataaggcgtgtaaagtgtcccgccatttactgcagctgctactgcagctacttgctgaatcggtgtaacagaaacaccttgaccaaaggcggtggtcgcctgctctacagggcctacacgatcaagcgggaacaaaattccccgcccctccccctgaaggtcaatcccagttttttggccaaatccgaaatttttgatataggaaaataatttttctttaccaagacggtctcctagctctacaaagccggggttacaggaattttgaactacttccaagaatgactgtgatccgtgtccaccttttttccagcacctgagtcttgcaccatcaactgtcacagatccgctgtcaaaaaatgaatcgcgttttaaattaactttcttctcttctaatgctgctgcaagtgtaataattttaaatgtcgaacccggctcatatgtgctccacaccggtagatttcggttgaacacttttggatcaactgattgatagtcagctggatcaaaatctggtctgcttgacattcccagcacttcaccatttttcggattcatcgcaatcgcaatcataccatctggatgatactttgcctgcgcgttgtctaattcccgctctataatagtttgtacttttgcatcaactgttaacttcatatcaagaccatctttaggcggtgtataatcatctgcttcatctggcattttctgtcccttggcatcagaataaaatttcacagagcctttttcgccttttaggtcatcgtcatagtaggcttcaagtccaagtaagccttgattatcgattccagcgaagcccagtacatgtgaaagaaagctgccaaacggataatgtctgatgctgtcttctgctacatacacaccttctaaatcaagctctcttacttcttttgctttttcatgtgatacctttctgccctcaggagaaattcgttcaattgatgttttcttcgtgacgtgcttgtacgctttctcttcagacatattcaacactgctgccaacttcttacttgtttctgcagggtctttaatttgccgaggtacaaccaaaatagatggagcacttttgttcgtcgcaagctctactccattccggtccaaaatatctcctcgttccggttcgaatggaaggtttcggctccatgaatctttagctaagcttgttagcttctcgcccataataaactgcacatatcctaatctagtatctatgatgaaaaaaatgatcaccccaaacagcagcacgaaaagcaatcgttttctcactgttacactcgacactcgcacgcccggttcactccttacatatggcttattttcatcatatgcaggcccgtccttttgtagaacgcaccgtgatattctgctggagcaaaagaaaaaacctagcaagtgatttgctaggtttaaagttaatttgggcttttaaatgtcacggtaacgactttgtctgaaatctccgctccacttttgacactttgtttcacagcatatccttgtccatttgtttctatatgcacaccggcaatcgaagcatattgaagaacttcccttctggaccagcctgtcatatcaggcatcttaatggtttttcctgctgtttttaagaagactttctggctttcagagaattcagagcccgcactcggccactggcgtttaatggagaggccgtcgccgatgacaacaggcgttaagtgtttatttttggcttctgtttctgcctgcttcacttctaaatctaagaatgaaggcatcgtttcttgtttcactttttgttcgcctgattttttatcgtctgtttttgttggtgcaatatttaaatatagcaaactatttttcatgacagggttaaagatttgagaaaccggagctgaccccgtttctgtttcagacagctgcggctgctgaacagccacatacacaagcagcttcggatcatcttttggcgccattcccataaatgaaaagacataatcgtttcttccctggaggtaaccgccggcaccgccaatttgtcccgttcctgttttcccagcaacgtcaaagcctttgatttgataaggctggcctgttccaattttcgaggaaacaacctcacctaaaatgtcacgaacttgcttcgctgtatcagatgaaatcggtttgcctgctgctgttggttcatgctgcaaaatcgttttgtttgtgttcgggtctgtaatatggtcaatgacatatggcttcatcatcgttccgccgtttgctatcgctgtggctgcttcgatttgttgaatcggtgtgatggctgatgcttgaccataagctgtcgatgctttgtcatattcatatctataattgattttgctagacgcttcgttcggcaagtcaatccctgttttgtcatagaaatgaaacttctgcaaatattgttcgtagcgtgtgaagcctagcttttcttttgccagctttgcaaaggccacatttgacgagcgaagaaccccttggtgaaagtcaattttcccccagccatttccgttgttgtggtctcgcacaaggccgccgcctactttataagtaccagattgatatttttcactgccttggtagactccttcttggatcgccgcagcaagggtgaaaatcttcatcgttgaacctggttcaaacgcatatgaaatcacatcattgttataattcgtaatgtctagttcatttaaattaaagcttggccgctgccccatcgcgagaacctttccagttttcggatcaacgactgtggcaatgattttcttcggcttatactttttggcaacctgcgtcatactttcttcaagaaacgcttgaattttctgatcgatggtcagcgtgacatttttcccgtctttcggggcgacaatgtcttctttgctattcggcaaagcccatccgcttctgtcactgttatatgtcacatagccgtctttttcttttaaaaatttgttcagtgccttctcaagtcccattgcacccgacatgtcctttgtcgcttcatttaacctggcataaccgatgaggttagaagcaaacatgccgtttggataatatcgcttcgtgtctttttcaaatgcaatccctggaagctttagcttttcaattttttccttcgttgaaaaactgatatccttccccgctttcccaaactccacttggaatgcatcttttgtattgagacgctttaaaatttcgctttcactcatatcgatgacttttgagagctcttttgccgtcttttctttatcgacgacatgcattggatgcttagggtccactgtcattttcttgctcatgaccgcaatgagcttatacacagatgtatcctcagcgatcacatttccattccggtctaaaatagatcctcttttggcttcaagtgttttcttcgattgatattgttcatttgccttggcagctaatacttgtccatcaactgttccagtaatttgaatataaataaaacgtgctaggatgataaagaaaaacagggcgaagcaaatacttgcaattgccgcgcctctgttcatcattttattctttttaggcatcgccatgttaatcgaccttcttaacatctttcgatatgcttaagcctgcttttttcgcagcttcaatgattctttctggttcactcagcaagtctttttccttttgtagctcagtgatcttcttcgattctaaagatacttgctgttctagcttctgcacttcgatattggcatgatagacagcaaaagctttagaaatgatgagaatcgagctgcacataagagccataacaaacatgacaagtaagattttttcaccaagcgtgatagaccctcttcttttaatgacaaccgattggccttgctgctctgtttgatgttgcttcacttctctttgataagccaaattactcataagaaacctcctttttatcatcatctatggtgtcgttttactttttttctgcaattcggagcttcgctgaacgggcacggttgttatgttccagctcttgttctgatgcaacgatcggttttctcgtgatcagcttgagttttggttcaagtccttctggaatcactggtagtccgtgcggaagttctggaagagaagacatttctctaaatgtacttttacaaatccggtcttcaagtgaatggaatgtaatgacagaaattctccccttcggattgagtaactctattgcttgttctagcgcttcttcaaatactttcaattcatcatttacggcaattcggatcgcttgaaacactcttttcgctggatgtccgccagttcgtcttgcaggtgccggaattccttctttgataatgtcgacaagctcacccgttgtttcaattggcgctttttttcttgcttcttcaattttgcgtgcgatttgcttgctgaacttttcttccccatatttgtagaaaatccgaactagatcttcaaatggccattcattcaccactttttttgccgacaatgcggctgattgatccattcgcatgtcaagaggtgcatcatggtgataactaaagcctctctctggtgtgtcgagctgaggagatgataccccaaggtcaaaaatcacaccgtctacgctcgtaataccttgttcattcagacgttcttttaaatatcggaagttgctttttatgaaaagaatgttcgctttaaaatctgcgagcttctctcgtgcatgatccagtgcagcatcgtcttggtcaaatccaatcaatgttcctttttctgataaatgagatagtaaatatgagctatgacctgctccgcctagcgtgcagtccacatatgtaccgtcttcttttacgtttaaaccgtcaactgtttcttttaataatactgtctcatgttgaaacatgatgttatggtcccacctttttcaaatagaaatgaatgtgtagaaagcttgctgcacaagggattattatatatcaaatccaatcatgttttcagcaatttcagcaaaagaatcttcttgctcttctgtatattgttcccagatcgacttactccacaactcaattcgatttgaaacgccgatgaccacacattctttttcgagttttgcatattggagtaggtttgatgcgatgttaatacgcccctgcttgtccagatcgcattctactgcgccagagaagaagaaccgtgtaaacgcacgtgcatcttttttcgttagcggtagtgctttgagtttctcttcgattaatttccactcactcatagggtagccaaataaacattgatcaagccctctcgtcagcacaaattgttctccgagaccgtctctaaatttagcagggatgatcatgcgcccttttgtatcaatcgtatgttggtattcacccatgaacatgataatcagagccccactttctcacccatactctccactatccaccacttctctccacaaaacttattctacactgtttctacataaaaaaaaaccctgaactagtcagggttcattaaaactttatttcaaagtttgacaatttgttgcttgttttgaaatgaaaatggcagatttttgaacgttttgaagaattctggaccatatttgtttaaaaagtacatgatattccaaattctttcctgcggggcatctagtggttttaaactattttcaattcgttcaaagtcccgaaggatatacccttccttctcttccacacgctgcgccaccttttgataaacaaattgaagctggtcttcaataaatttggcatttttatctagcagctgctcgaagtttggttcaatctccagtgcttcttgtctcatcacgccatgagcatttgctaattcacgtttggcgtgttgaaccgcttgaacaaagctgtctggaagactttgctgaaagtgcgcttctttcttttcttttactccatttgtcagcacttcttctaccgacagttctctaactggcagtttcttgtcgatatgcctttcaagaatggtcacatgcaacctcggaagaacaggcgccatctttaatttaaaatgctcaaagattcctttcagctctccccaatagttaacctcaccgtgtcctgccataaaggcaagtgtcgggagaagggtttcctgcatcaagggacgcgtcaccacattgttgctaaaccgttctgggtgctcctccacttcctgcaaaagctcttccttcgtccatgtaagccccacttctgatatagaaaaccggccgttctctttttcaatcaggaaacgttcctcatcatattcgtaaaacagattcgcctgattgtcaccagcttcaataatcggctgatatcctgctcgtttcatagcagcctgtgattcatttaagcgagtagtaaccgcatcatttgtctcgacaatgtgcttgaataacgcacgttcgagtggtttaacacctaagtcacctgaattaagtaaaagcagtccatcctcttcaaagaggtcacatacaatccattcaaagaaatcagtaaacgtttgtgatttgcgtaaacatcgaagaagctgatcaagcaagtcattggtgtatgcagattcttcatacgttgaaaacacatcacggagccatgtctcggttttttcttgatcaagcgggattcttttcgcagccgcttttttgacgttatgtaatgacagcttttgtttcactggccctttttcgccagatgtgtacacaaaattaatttcatctacgtcatgatcctcaccggctacccaaaagaccggaatcactgggacgccaagctctgtttctttttcttttgcaaactgaatgatggatatgattttatgtatggtataaagcggtcctgttaatagaccagcctgctgtcctccgaccaccatgacactccgttcatcacggatcttttcaatgttctggcgcatcgctgccgattcaaactttgcgtggtatgcgctcatataatccgctaaagcctcgcgcgggaagctcatttccatgagatcgtcgtatctctttttccatgtgtgctcagaatgtatatcataatcaaaaaaagtcgtcatctcttttttttcttctatataatcacgtatgaataaattctgacttcggatggaaagttcagtcaattgcatgtttagaacttcctttcttcaataaatagttagtttcccgaaaaaagtatagcatgtaaatgagctcactcaaaagattttgtttgctttttttccaatacttccaagcttcgatcaaagaaagtgagatgtggcgccgcaacgccgtgagcttgagccttttttaaaagataaccaaggatggcttttctttcggtttggcggcctttcactatatcttgaagcatcgaggactgattcttagcggttttctcacaaatagaaactacataaggccagagccgctttttttcagacaagcccaagatggaaactgcttcttcaaatgcacatttcatcatgtgttcatatgaggagtttgcgattaattccccgttcctcacatgcagcaaagccgtgagcggattgatacagacattgacaagcagtttttcctccagcacctttatccattcatccgtatagatcatctgaaaatgagatgatgtctcattcaatgcattttttatatctgctgcttcttcatgctgatatgccccccacttgatgacaccgatacctgtatggttcacttcatgatctgacatcttcatagctccgtgctctaccacacctatgtataatgagtgtcctgttttccaattctccaaatctaataagtgagccattccgttctgtaaaaataagatacgatgaggaggtaatgtcgatagttcacgcagcacatcttgcaaatgatgatatttcactgtcacgatgagcaaatcaaattctcctgttattcctgtctgtgcatgaacagttgcctggcatgtatctccttttcctgttcgctcaatgccgaatgctcgaatctcttctgcctgttcgtttcttcttgtaaagactgtgacgtcatgatgctgcgttaaataactagcacaaagcagaccaatcgcaccgccaccaatgattccaatgttcaacttccgcacatcccttttttgtttacttcatgatatcaactattttaacaggttcatgtcgtgatgcaaaaagcagatggcgcgccatgattgaatttttttaatttaaaaactataataataagtgtgaaaactttttgaggcggatgggatgaaaacgccttcaatgacatcactgtcgacattatgtgtgtaagggggaagatcatatggcacaagtaaaacgacttctaattaattacaaaactttagaggaatttaaacaatttaaggaatatggcatacaagaactatccatgcttgaagaccttgaaagcaatatgattgaaaatgacagcaactctccattttacgggatttattttggagataagctagtggcacgtatgagtctttatcaagtggacggctcaacaactacgtattttaaccacaaccatgattatttagagctgtggaagctggaagtgcttcctggatatcagcgcaaagggtacggcgaagcacttgttgaattcgctaaatcattcggattgccaattcggaccaatccgcgtgtcaaatctgccggtttttgggataaaatgggctttgaagcagtcaaatatgatatggagcgcgataagggtgaaaatccacttatctgggagcccgcacatattcaaaaaaatacaggtgaatccgcttaaaggctgatcacaaaacgcccctcctttctctgtgaggggcgtctctttatttagcatattcttttaagctaatattctgtttgactctttcaacaatacttatgagtgcccggtaatcttcttctgtcatttttaattgtcgcttcaagtgttcattttcttctgtaagtgacttcaattgatactgtgcatctgccagttcttcgcgtaaatgagcgggtccatcaggttctttttcaagctgctctaaaaactgaatcacttctcgaagggtcaattcagcctggtttgaagaagtcttttcttctatggttaacgcatgctgtggtaaaccagaggaatgaatacctatttttttacgcaattctttccgctgtttttttgccagctctatgcctgcctgatattgttttctaacgtatgagttccacctgaaaccacatgctgccgctgttcttgacaatgctttcccgacttcctcaaatgcggaaagctgcgttcctccatctcgaatgtgccttaaaacgacttctgctaaaagtaaatcttcatcctgtgtccatgcgtcctgccttgtaatcgtcaattgatcatcccccctgaatctgaataccacatcatatgcgcctactagagtagatagactatttgcaggggagaaacctaaaaaatagacaaataaaaaaacgtaagggaaggttccctcacgtttttttattaagcattagttgctttttacgtctttgcctttgtatgttccgcaagatttgcagacacgatgagaaattttcatttcaccgcattctgggcaagctaccataccaggtacttgtagtttgaaatgcgtacgacgcaatctttttttcattttagaagttcttctaaaaggtacagccattattcccacctccttaaagagttaagattcattattttcttctaagagcttcttcaagccttccagacgcggatcaattcggttttgatgtgcatcttccgaaatgactgcccagtcattcccttcttgtggtgcagcaccttttacgtcagtttggtcgcaaaagatttgcatcggcacttcaagaagaatttcttccttgactaaaggcgttaagtcgatgatgtcgtcttctacaatagaaacgtcttcatcttctatgtcgtctgtcttatgaagtacaaatagttctttcgttgaaatcgcaaatggataatttacatcaacaagcgttcttgaacaaggcaatgtcatttcacctgtgatggttaaatcaaatgcgacttgctttgattcgatcactccagtccctttcacctctaccggtgaaatgcgacgtatatctgaatgaaggctagtaagttcatttaagtcaaccgtctcatgaaaatcgaagctgtttttagctttttgatgtaactgataaactgtccatttcaattgtatcacctctaagagcaacaaacatgattatagctttcatcatgttatttgtcaatattttttctttacagtcctttgtgatgtcagagcgttgtttgacatcagttctcggaatgcctacactgaaaaaaatgggcttcatttttcccttatgctactgtagcatagaccatttaaccatagcaagaaaggcggaacttctattgaaagcaacaggagtcgttgtcgagtataatccatttcattatggacatgcctatcatgttcgtcaggcgaaaacacatacctcctcagatgttgccattgccgttatgagcggtcccttcctccagcgcggtgagcctgccatcgtctcaaaatgggcgcggtcaaaaatggcacttcaaaacggtgtagacattgtgtgtgagcttccatacatatacgcagtgcaaaaggcagaaacctttgcaaacggtgctgtggcgattctagatgctttaaaatgccgctccctttttttcggcagcgaggatggtgacatcaaagcatttgagcgaacagctcgtgcttggcatgagaaaaaagaagaaattgactttttcacaaaagaaaaggtgaaagaaggccttagttatccagcagctgctgctgctgcgtttcaagaggtgattgatcctaagcacttactggatctgtctcggcccaataacattttaggtttccattatgtcaaagccatcatggagcgatcccctcacatgcagccctttacctctcaaaggatttcatctggttatcatgatgaagaactacctaaaaatcagaaaatcgcaagcgcaacaagtatacgaaaagccttaaaagatcatggtgcatttgaaacagtcgccccttatctcccaaatgctacgctcaagcaattacatgactatcattcttcatatggtcttctacatactcaagaagcctactttagcttcttaaaacacgtctttcacacaatggatacggcagaactagaaggcatctatgaaattgaagaaggcatcgaacaccgcatgcaaaaagcgattacacatgcgtcctcctacgaggaatatctatcacttgtgaaaacaaaacgctatacgtggacaaggctgcagcggatgaatacacatctcttaatgagggtgaaaaagaatgccatgcatgagctgctgaaagagaaaaaagtaccttatattcggttacttggtatgtcaaagaaagggcagcaatacttatctcttgtgaaaaaagaattggacgtgccgctcgtcagtaaactgtctgccttttcacatcccgctcttgatcttgatatacgcgcatcccgcgttttcagcctgcccgttagtgaaccaatgcaaacgaacttaacggaagcggaatttaaaacctcaccgatccgatatgatgaagagactggtctcttccagtcttaacaaaaagagcagcctttacgaaggctgctccatatcgttgacaaagggctaaaatgatctttattttagtcctttgtcttcttttcagcatgatagaaaacctttgaagtctaggaaggacgagtaccggagcggagcgaatttgacattcgcgagcaccggcacgcagtcctgacaaagaatgcaagggtttgtctacatgctgagagcagcctttatgaaggctgctcttttttgattaagatgctttctcttttaatttgtttaaatagttcagcgcatcttgcattgtatctacaggcacaattttcatatcacttttaatatcttttgctgttttgacagcatttcggtagtctgagtttggatcacctttatcgttcggtgcaaagaatatatcttttccggctttatctgccgccacgaccttttgatcgattccgccaattggaccgaccgttccatcggcatcaatcgttcccgtccctgcaatcgcgtagccatgtgtttcgtcttcttttgtcagctggttataaatttcaagtgacatcataagacccgctgacggtccgccgatattttcaatatccaccttaatggacggtgagactttcacatttcggtctgtaaataatgatacgccaattccaactcgattcggctcttctttaaatggttttaacgtcactttctccgtaatgtctttgccatttcgttcaaggataaaacggacaggtgtacctgcttttttgctgctgatatacgaaaccattttatcagcagaatcataggtcttgccatcaacgcttttgattcggtcgcccacttcaatctttccgtaagcaggcattcctttcatcacgtagcttgcatatacgccgttaaacgtataatctactttttttcctgcttttgtatatgctgcaatcatggcattttcttgagagcttttcatcagctgaagctgccttttcatataatcttgatccgactccccgtccgctttcatattttcttctgggacgatttcgtcatatttattcattttcgcaagcaaatacgtatacggattggctggacctactttaattgtcataagagagaagctgcccttctcgtcatatccgccgtctacttgaatgtggggagcaatctcggttgcatcacccggctttgtcacgtaatatggcagtttgacaaaggttaaaccacataatacaaggataacgacaaaaaagctgagccagcgaatattcaattttttcattcgattaacactcccatttatcaatgacatctttcagtttacctgttagttgatctgcggcgagctcacctgcttcaatcatctcctgcacctgcgtgaacgcgctcgagctaaatgtttcaagcctcggccgaatcatgacatcagcgtgaatggtttgatgacggaccaattcattttgaaggatgtccaaactttgcataatgacatccgataatctcgtcgccttttctgtttttttcacccttgatacatcagaggcgataatgaggtctgcacccatatcttttaaaacagacacaggaatgcggtccaccaccgctccatccactagctgtctgccgcccatttcatgaggaacaaacacgcctggaatgctgatgcttgctctgactgcttgtgagacagacccttttttaaacacgaccttctcccctgtctcgaggtcacaggcaaccactgcaaggggcattcttaattcttcgaattttttcccatatgtaaacgtgtgaatcagctgcaaaattcgatttccttttaaaagaccgatttttggcagtgtatagtcagcataatactttcttctgaagacaagtgcaagttttttcattttttctacgtcttgtcctgccgcataaaagctcccaacaagtgcgccaatactgctgccagcgatcatatctacctgaataccttgtttctcaagactagataaaacgccgatatgtgccattcccctcgcacccccagagcctaacgcaagcccgatgactggtcgcttcatgaaaatccaccctcctcttttctatgcatatatacgaatctattggtctaaacatgccccttctgctcgtatagtaatagaagacaggctcggctagtttctttcttttttgatcacgagctcgccaatagatcataacggcaaggggcgaaatctccatgaaaaaatggaacactctgttcatcgctgctttttttatctttttaacagccactgtgattacacatccacaagcctctttgcaagcatctaaaaatggacttgcaatgtggtgggaggttgtatttccatcattgcttcctttttttattttgtccgagctattaattagtttcgggattgtcagatttgtcggggtattattagagccatttatgcgtcccatctttcgagtgcctggtgtaggcgggtttgtcctagcgatgggaatggcatcaggctttccttctggtgcgaaattgaccacaagactcagacaggaaggacaactgacacaaatcgaagcagagcgcctcgtttcttttacaaattcatcgaacccattgtttatttttggtgcggtggctgttggtttttttcatcatccagctttaggaattgttttggcctgcgcacattatttagggaatctcgctgttggtgtgacgatgcggggatataaagcgcggcaagatgcacatctgagaagcggtaagcgatttttattcccaccgtttcaagaggcattcagtgctcttcatacagcaagactcgcagagaaaagaccgctcggccaaattttaagtgatgcggtcatgtcatcagtccaaacactctttatgattggcggctttattatcttattttctgtttttagcaaaatgttatcagttgttcatgtgacggatctcttatccatagggatcggatatatgctgcaaacgatgcatcttccgccagaattagatcttgcgatgattgccggtttatttgaaatcacgttaggaagtcagctgacagggtcacaggaagtcacccttcttgctaaaacgattgtcgtcagctttatattaggattcagcgggttttctgttcaagctcaggtcgccggcattctggcggcaacagatatacgctttaaaccattcttcttcgctcgtttgctccacgggatttatgcagctatttttgcctttttattgttcaagcctctttatatctctcgatctgacatggctcttccagcaggtgcctttgaagcaagccagcaggtcgtcatgtacagcagtgtgctttggaatcagcttgtgacagccggccctttgatcacgctatgcagcttgatcttgtacacggcgctatactatcagaaattaaaaaaaggatgagtgcacggtgcactcatcctttaaatttttctatcagcgcttcttctacctcttttggcacaaggtctttgactgaaccatcatatttcgctacttctttgacaatgcttgagcttaagaaggaatattgattgttggtcatcatgaaaaatgtttcaatgtcatcgtttaacactttattcattgatgtgccttgcatttcatattcaaagtctgtcacagctcttaatccgcgtaaaatgactttggcttctttttgtttcgcataatcaacaagcagaccgtgaaaggattcaactttgatatttggcagatccttcgtcgcttggcgaataagctcacaccgttcttcaacggtaaataacggtttcttggatgagttatttagtacacatacatacacttcatcaaagatctttgcacctcttttgatgatatccaaatggcccaatgtgactggatcgaagctacccggacaaacggctatgttccccatgctttaatttccccgctttctatagatcgtaataccagtcaacccgtacagttcctgtcttgatatgtaaagctgtccagcttcctctggcagtgtgacgtccttatcatgctcacacacgatcactccgtcatctgttaataacgcatgctcgtcaatcatgtcaagaagtgctttcagctgttgatctttataaggcggatcaagaaagatcgcttgaaaggattcctctcgtttcacaacggcagcgagtgcacgctttgcctcatttcgaaacacttcactttgatcaatcagctccaattgattgaggtttccttttatcgtttgaatcgccttcatatctcgatcaacgaatatgcaatgatcgaatcctctagaaagcgcttcaatccctaaaccaccgcttcccgcaaataaatcaagcgcccatccgccatcaaaatatgggccgatcatattaaatatcgattcttttactttatctgtcgtcggtcttgttgattgacctggtaccgctttaagtgtgcggccttttctcgttccagagatgactctcatttttccaccactttttctgcttgcttctattggttattgtgtatgacaaaaaatccaacattatcttaccacaacactccgcaagggacaatgcgcggactttcattcattttctatgtatagatcaaggaaagcggggtcatactacttataacagcatctgatgtggtgctgttgccaaccgcggagaagacttacgtttccccataagttcttcctccggtttctcctctccctttgccttctccttaatgaatcattaagaatagaaggaccccgcgggtgatgccgcgggggtttttttgtgtctttaaaagcccactttataatcatactcttttgctttgtccaatttggattcgtactctaatttaataaaaggtttatatgaaggttcaacacgcttcacaaatggcaatgagctgagcttagccatatggcgctcgagatcattcatatcacaatagatcactgcatatttcattttccttgaaatatagtgaacatttccaaattttcttagcgcctttgactgctttaacgaatgcagccaaacgaccatcccttgacgtttggtttccatcttttcacctgccgctttttcaattcttttcagttattatgtaaaagacgagacattcaagtctcgtcaagatactttacagccacagctgccaccagatccacagccaccgccgcatgatgatagaccatcaaaatatgggttccctgttggaactttgatatatgctgatacagcttgaccgatttcaatactaatctcatctaagatggattgaatcgctgtttctgcttttttgaaatcaaccactgtatcgtgaagatctaactttcttttgacctcacgcatttcctttgagatcgttctatagtccggatggtatttgccgaaccgctgcacatcctcatattgctcttttacttttgtaaaatgggcaataatttgttgggcttcttcgtcttgctggagacgcttaaagcagttgcggtaatgttcagcctcctccgactgaagaatcatggcagccaattgatttgcttcctcttggagctccacagattcgattgtcgcatacataaatgttgcacctccaattcatagtttaccacgaaacctatggatcagaaaatgcttttacgtcacaaatacatcccatgtctctcttttctgcctatattctggatgacgagaattgagcacaacggtgattttatgttttccttttgaaagatgcttgaccacaaatgcagcagtatactcattgcctgcacgttttccgtctacatacactgtaaaatatcccgccttctcatctttttttagtcgcgtagactcaagatgaaaatcttgaagtgtactttctatatagactgacgacccctgcactttgtatttaaaaaagccttgctgcttcatttcactttcggcttgttgcatcactggtacagctggatcttgcttcgtgatttgcttcttttcatgttgactttgacacccggtgacaagaaaaagcaatgcgcacattgacagcatccatttcatcatctgattctcctttcatctacttttataggatgctcaggaaatagacatcttaatcaactcaaaaaagcctcacccggctccattttgattgcgcattgcttggaacatttgaatcatcatttcagccatttggacactgttactcaactgactcacacgatgaggaatggttttttcgtaaaaattcattttatctaattcaaaggacgatagcttatcaggatgtcgagtcagctgtctgtaccagagaggacgctgtctgatgaatttgattcgttcctcttcggccatgacaaactcctgtacttctttccgcaccaaaagcatcccctttcaattaatctttcctgaaggagaatgggtgctgactgcctccagatgaacctttcttcgagccatttgatgaaaattgtccgagtaagctttgtaaagaggaaatagactggctcattttgttgatttgttcattcatttgttcagcgtccatttttttcacagcagaaaccattttagacataaaatctgcttttccagattcacttggctttgaggctttttcttctttcacgtcctcagattgcgtttgccggtaaggagaccacatctcatcttcctcaccaaacatgacccaattttcgtatacactttgccagcttttttcttgcgtttgcacttcttgaattaacttcggatggcgtctgacgaattgtttaaattcatcaatggatgtttgtttttgcttgtttgtcatatcctcaccccccatacaaatgcctactatactatatacaccatcagttattttggtgagcctcttttttgaaacaaaaaaacagctgcgatgatgcagctgttttcgtttaagatgtttttttgatgaagttttgggtgtagtatttttctttcacaccgacgccaaggtgtgagtaatctttatttaataacgcctttctatgaccttcactattgagccagccttctaccgctgcaggtccatctacataattataggcaatgttttcacctgcgagttgaaatgccacctcgcctctttctaatcggtctttcagcgtaccgtattttttagattcatgggagaaataatgattctctttcatgtcctcactatgcatgaatgccacttcagaggtttcatcatcccactttaaggtcggcagtttgtacttatgacgaataatattggtcatatcaaaaatttgtttttgactggaagcttcgatctctttccatttttcacccgatattgcctctggttctatcaattgaccacgatagacgacttcgtatggcttttgtttcacaaatgtatctgcgttaaacgccctgatacttgaaagggtgctttcaaacttatccatgtaaagctgaacatatacatcatcgtccactttcacggtgggccttgtattcatatcatcttctgagaattcaaagcggtatgaattttgttcatcctctacatgaatgtaaggtgcaatttgtgtttttttaaatacctcacttgtggcttgaccgattttaaacggttcaacattgagcccgtctcctgttgcaaacaatgtcaccactttactatcctttacccctacttgaatatagtgcttcttcgattgattgtatatccaccagtcataatcatatgcggaaggatcaatgcgatctggttctcccagctgtttaagcacttcgtttgaagattttcccataaaggacatgagcccctttttcgggatgttgatcggcttatcgctagatgtttcttcattagacaccttcggttcattgctgttttctttttctggtgaagatccatattgaataaacagaacgtacgttccagatataatcaggaggatgaggagtgttttgagcacagttttcaaataaacacctccgttaaattggcaaggtacaaaaaaagtaccttctactgtcatttaaacaaaactcgcttcatttatcaacgacaatacagcctatttaacacgaatttaaaatatgcccctcttaatgaagaaatccttgcccatgatcttgatcctgttgagagatttctgtcagggcatctcctgcgcgatcattcgataaatcttcgacggataaatctccaagagcgacaatcccagttaatgcaccgtttttcacaacaggaatgcggcggagctggtgctctgacatcagccggacaatttcttcaagcgttgcatcttcttctgctgtcagtacttccttcgtcataagcgagcctacttcctgtgagtttggctttttttctgcaatacctctgagtacaaggtcacggtctgtcacgataccaacgagctgatctccgttaaccaccggaatggccccaatgtctgcgtctctcattttgactgccgcttcatacgtattgtcatcttgctgacatgtcactactttttttgtcataatatctttgatttttttcgttttcacgttgattcctccatctgttattttctttattactgtaaccaggttataaaagaacatacccttcacagttgaaagtttaacgctttcatactatgattgtcagtaaagggaatttttataaggaggggttttgggtgaagtttgaaggtacggggattgaaaaggtagcagctgacttaaataaattagatttcatcatggaaagtgaaggatttgtacgagccgatcaatgggattatgagcgtgtgacgtacgacagaaagtataacatggtagagggaaccttttatttacggatttccggctacgccaccgaaggagatgttggttcaaaaagagcacacatacagcttctcacacctttactcggaaaacattattatccgcacggtgttgaatatggcgaagacgaagatttccctaagtctctcatccaatcaagcaaaaaaacgcttgaacagctgaaagaaaaactagaagcaatgacagcagaagcataaacgaaagcacagccatatggctgtgcttttttcattcatatttcggaatcagcgcatctggtacggcatctttcgctctttcttttcttgcccagtcaaagaagacaacagcaaggattgagccgtacacaatctcctgaattattttcatcaaaatcgcgcctagctgctggtcttctagcagcggcaaggtatggaacatttcaggacctgtgagcgcaagacctgccagcgtatcacttggtacgcagagatgcagcgcctgtatccaagcaccagcatcagaataggttgcatagatcggtgtctcactaaacataatgagtgcacatgcaggagtcattaatatcccgtctgccataatataaccaagctttaaaatgcctgtaatctgaggctgactttggactttatgaacgagcggccaccacatgaaaaaggcagcaataaaaatgaccactgtcatcagcgcatgataaaacggatctgttttcacaaaatcaaacacaagcgggatatggtacatcgaaaacaaaccgttaaaccccagcaatgcaattaaaggcttggtaaacaaacgaaacatctgctgaatgcctggtgtttggatgattcgctcccaaatggccgcaggtaatcctgtaataaggagaggcggaatgactaaatagagcaccgccatttgcgccatatgcgcactaaacataatatgccccattaaatcaattgggcttccttttacggcgtataacagaacaagccccgtcagaaacaacgttttctcttttaccgtcgcacgatgcttcccctttgtcacaagaagcagataaagagcagctgctatgacaatactagtcaaatagtaagggctccataatgcccgaaatccgaatatctctaagttctccattgctgcgcctccttcaagggcaaagcgggcttaccaccatataatggtcaaaaaggctaatacggtaataaacgcgacaaacacacctgagtaaagaaacaatgcgggtgtttcatgccctttttggttcatgtgcataaaataataaagctgaaaagccacctgaataacggcaagcagtaaaataaatggtactgcgaaccagtttccaacatcttcagaagcgattgttaaaaaggcaacaaaggttaatccaatcatcaagccgaaagaaatgagctgatgcttcatttcttcggcatttttctttttacggtatacaagatcgactttagactgatttgtgtttttatttcccattcttatcccaccattcccattaaatatacaacggtaaagatgaagacccacacaacatcaatgaagtgccaatacagacttgccacataatattttggcgcattgtataaatcgagtccgcgtctcatatttcgaatcataagagcggtaatccagcaaagtccgaaggcgacgtgagccccgtgagttcctacaagtgtatagaaggaggaaccaagagctgagctggtaatggtaaaatcatacgcatgcacataatgatagaactcataaatctcaacccctagaaatgaagcacctaatagcacagtcacaccaagccaaagctgcatctttttaaaggcaaagtttttcatatgatacattgcatacacactcgttaaactgctcgtcagtagaagcatcgtggcaataaagacaagtgtgagatcaaacatatcagttgtttttgctccgcctgcattagagtttttcagtgccaaatatgtggcaaagagcgatgcaaacagaacagtttctcccccaagaaacaaccagaacccgacgaacttattctttccttctaaagtggctttctcaggagaagccggaaaagtttctgctgtcattttttgtggttccattatgctttcacccctttatcatcgtcatcggtcagatcttctttgtgaatatggtacccatgatcgtctttaagagagcgaaccagcatggttgcaaatgtaatgccaagaccaatgagaatcactggaagcccccagctgtgctcttgacgatacatgaagccaaacgctgacacaaatagaccgaatgagataatgacaggtaagatggaattattcggcatgtgaatatcatcgagcggttcagatgctgtcattccttttttaccatccattttttcaatccataatggatctagtcctctgacaagtggcagctgtttaaagttatattctggcggaggtgaagacactgcccattcaagcgttcttccgtctccccaaggatcgcccgatacacgctcccctttcgctgtcgtccagatgacgttaatcagcaggatgacaacagctacaaacataaacagcgccccaatcgtactgaccaagttcccaaggtctaacccctgacctgggagaaatgtaaagactcggcgcggcatgccccaaagaccgaggaaatgctgaataaagaaggttaaatggaaaccgatgaaaaatagcacaaagctaattttcccaagcttctcatttagtatttttccaaacatcttcggccaccagtaatgcacaccagctaaaataccgaataccaccccgccgataatgacgtagtggaaatgcgccacaacaaagtacgtatcatggaactgataatctgctgcagctgctgcaagcatgacgccggttaccccgccaagtaaaaatgacggtataaaggcaacggaatacagcatcggcgttgtaaacttcacattaccgccccatatggtgagcagccagttaaatactttaattcctgtcggcaccgcaatcgccattgtggctacagcaaagatggcattggcaatcggaccaagtcctgttgtgaacatgtgatgcgcccacaccatgaatccaaggaaaccaatcaatacagtcgcaaacaccatcgacgaatagccaaacagcctttttcttgcaaacactggaatgatttcagaaaatattccgaatgctggcaggattaagatataaacttctgggtgtccgaaaatccagaacaaatgctcccagatgattgtattaccgccgagctctggattgaaaaagctcgtatcaaacattctatcaagcatcagcattgcaagccctgctgtaagcggcgggaatgcgaataaaatcagtgctgaagcgacaaatgtcgtccatgtaaagagcggcattctcatatacgtcataccaggcgttctcatattaataatcgttgcaagaaagttgattccggcaattagcgtaccaatacccgctatctgcaaccctaaaatatagaaatccatgccgtgtccttctgaattcagcgtgagtgaagcgtatgcagtccaacctgcatcaggtgccccgcccataaaccatccaaggtttaagaaaattcctccgaaaaagaacagccaaaaaccaagtgaattcacaaacggaaatgctacgtcacgtgcaccaatttgaataggtacaaccgcattcattaatgcaaataaaagcggcatcgctgcaaggaaaatcatcgttgttccgtgcatcgtcatgacttcattgtaaaaccctgcacttacaaaatcattttcagggatggctagctgaatacggattatcatcgcttccaggccgccaattaaaaagaaaaatccccctgccactaaatatagtacggcaatttttttgtggtcaaccgtcgtcaagtaatcccataagacagcgccaaacccccgctttttagctattgtactcaccatgaaatccccctcttatctcccatttgccccttttcatatagatgtctattttaactttacacagactgtgtctgacagatggctacttcttggttgtagagacatattcgggagctcttaacaaaaacttcacatcgattacataccctcttgcccatttgcattcgaatttactggattttaagttcttttaaatactcataaagtgcatctgcttctgagtcatttaatttagggtacgtccctgtcattttatttcctggtttaaagctctctggatctttcagccatgctttcacgttttctttgttcatgtctttaattccagctacttttgttcgctctccgaaggttgcaaggtttggtgctgtccttgccgcttccggccgttcgtccccaggctctactgcgtgacagctcaagcagtttttctctttaaataatttttcaccttcaagggcgagatcttttgtggatgtaggcttcttgtaatcagccatttttttcgtccatcctaaaaactcatcttgagaaagcgttttaactttaaagtccattaaagcatgtgaaggaccgcaaagctccgcacatttcccgtagaaatattcccctgcatctttcgttcgttttgaatcaaaggttaaataaaacttgttttcgttgtctgtgtttgtatcaattttaccgccagccgatggaacccagaaagagtgtttcacatcagatgctttcaatttaaagtagaccttttgatctgttggtacaatcaattcctgacttgtgacaatcccataatcagggtattcgaattcccaccaatataaactggctcttacattgacaacaagtgtcttttcaggatctcgttttttcttatccatagcgcttgtatccccaagctcaagcgtgtatgccacaacaggcacaacgagaataatgaggagaagaatcggaatcgctgtccacgtaatttctagattacggtttccttccacctgctttggaatcgtatcttctcccactttagaacgtttgaatttaatgatgacgtaaaagaaaatgatcgatacaacaatgacgacaagaaccataatgagtgtactcagtaccgttaggaagaattgtttatctgctacttccccaactggtttgagtgttgataagtatggttcaccacagcccgccaaaacgagcgtcaataagagaaacagtgaataaacacgccattttcttatcataatttgtcccaaccccttttgcttgatctcctttgcctttcgctttttacctcttatttataaaatcacttttcacccatccataacccccgcctcttataaaagcacttacatttcctcttttcataaaaaaatgatgtttttactcaaaataccatctatgtataaacagaaagccgcctaaatagaactgaatatcaggcggctttcatagttgttagaaaatgttgtgttataagatatagccttgttttgatgtgatcaaagtgtattttactctagaatagtgtaataataatcatcgcaacgaaaaagatggttaagtaatttaatgaataaacgaacatgagcgttgaccacttcatgacgtctttcattttaaagcccataaggccaatgacaagccatccaatattcagcaatgtgccaagtgcgacaatcggccatcctaatccacctaagaaaaatggaagcgggagaagacatgctgtccaaatgatgatttggcgtttcgtgacttcaaagccataaacgactggcagcattggaatacctgccttacggtaatcttccgttttcttaatcgcaagtgacaggaagtgcgggatctgccaaatgaacaaaatcataaacaaaacccaagccgttgtgtcgattgtacctgtgacagctgtccagccgattaatggcggcactgcaccagacacacttccaataacggtattgatggtgtaatgacgtttagaccacatggtgtaaagaaccgcataagtaaagactccaataaatccaatcactgctgatgttatggttgtcattagaagcatgatgagtccaagtacaacaagcaaaataccaaatgcatacgcttgccccggctgaatcttacctgtaaccgtcggtcttgtttttgttctttccattaatatatcaatatcacggtcaaacgcattattaatggcgcatgaaccggcaataataagagaagaaccaatcattgttaacagcacaatatctagattcccaaggaaactcatccctgtaaaataaaaagcaagccacattccagtaaatgtcgtaatgaaattggaattgacgatgcccattttaatcagagcaagaaaatctttccaagctgttgtttcttctatttgtccatgaatagctgcttccgcggctgttttggaatttgccaatgtgtataacctcccttgcccaaaccttcaaacgaactatgaaacgtaaattcgttacaactctatcatacaagataaacagctgtaaaaaaacatcctattaaataataaacgacaatctcgaagttatttgtgaacttttcgtgaatttattaggatttatctgtgtttcagaaggcggtgcaaaatgaaatattctctcctctatttctatcagactgtgaaagaaagatcaagcactctaaatctgtaaactttgtgaactaacatatcatttttttgtgaactttggtcattatgaattgcaacagaacacgcatttggcttaaacttgagagcatgtgaggtttttcatttagatcagaagttttttagagaaggtgaaataatttgatgaaatttgctttaaggttattgagcgtgatcacaacgtttgtgatgctgatcgttttgattggcggtgcgcttgtgacgaaaaccggctcgggtcttggctgcggcaggcagtggcccctttgccacggtcgtttcttccctgaaatgaaccctgcttccatcatcgaatggagtcaccgcatgtcaacaggggtttcaaccattcttgtcttggcactggcggtcttatgctggaaaaagattagtccagtattccgtgaaaccaaatttttggtcatcatgtcgattatattcttactgctacaagcgctgttaggggctcttgccgtcgtgtttggttccaacgcacttgtcatggctctgcacttcggtatttcactcatttcttttgcttcagtgttattgcttgcgcttcttgtattcgaggcaacccgatctgaaacaaagcttgtgaagccgcttcatatcggcaaaaaaatgcagtttcatatttatggtttgatcacctatacgtatatcgtggtgtacacgggtgcttatgtgaggcatacaaagtcaagtcttgcttgctctgtcttcccgttttgttcaaaagacggtgcacttccagcgtactttaatcagtgggtgcaaatgtctcacagagcagcagcacttcttttattcgtctggatatttgttgcgatgtttcatgccatgaaacattataaagaacagaagcagctgtattatggatggattatttcagccattcttattacacttcaagcgatttcaggtgtgatgtctgtgtattctcatctcgcacttggttacgcgctggctcattcattatttatttccggtttgtttggcgtactctgttacttctgcttacttattgcccggtttaaatatgaaagcaaagaaccattcaaataagaatttgtatcccccttccatatggaatggggatttgttttattgttgttttgcttcttcaaatagcgaaatggcttttttgcgtctttcctggtggtctaccgtcggcagcggatatgtatcacctagcacacatcccgatttcaattgctcatcaatcggcattttacttggttcatgaatccatttttcatcgacatactctagctctggtacatattttctaatatattctccgctcggatcaaatcgctttgactgagtggtcgggttgaaaatacggaagtacggcaccgcatcagttccgactgaggctgcccactgaaatcctccgatatttgacgcctcatcataatccacaagtttttttgcaaaatacgcttcgccctttctccaattaatcaaataatcctttgttaaaaatgaggctgtgaccattcgcaaacggttatgcatccagccctcctcatttaactgtctcatccctgcatcaacgagtggaaagcctgtttctcctttacaccaagcttcaaacagcgtctcatcttcattccatttcatcccttgaaacgccaaattgatttctttttctttcatctcgggataatgcgcataaatcatatgataaaaatcacgccaagccagctctttaataaaggtctctctgccctcatcttcatagagtgcttcttcatatatcgaatgaaagatcgttcgaattgaaatagtacctgtttttaagaaccgcgacagcttgctcgttccaaaaacagacggaatatcacgtttctcatggtaacgtgttaatcttttttggataaagtgatgcagcgtgctcatcgctttgtctgagccaatttgatcaaacttccttgagcagccctttatcaattctcgcagtttatcatttcctttttgtgaaagtgactcatcacaaatcgtatgcccactgctaaaaaatgatttgtcaacttttatcacaggctgcttctcttgcttacgccatgattgatagtatggggtaaacacttgataatgtgacccatctgcttttaaaatatctcgcgccccgtgaagatgtgtatcttgccacattgacacatgaatgcccttcttacctaaaaaatcggttacttgcttgtcacgcctttggccgatacccacttcatcttcattaaaaaagacggctttgatgtcatacacatccatgacctgctgaaaggcgcggaggacatcatcatggagaaggtggacatacacttgagattctctcgcttccttgacgaaatgcgccaagctttgaaagaaatgttcgttatttatatccatttccatttcagtaaaaaatggatctagatgataaagagccaataatttgtactcatgtttttttgcatatgtgatcgcttttgacaaggcgatatgatcatccaatcgcagatctcggcgaaaccaaatcacgacaatttccaactttcttcacctcactctatagtgtaatcactctcgcaggctgctgcacattttaatgcgctcaaaaaaagacacatcacgatggatgtgtctcaattattattcaggctttaaaacaatgagcagatctcccgtttgaatcggttctccatttgtcacatgtatttcatctacgaccgcagtgaatggagcttgcacagtcgtctccattttcatggcttcattgatcatcaaatgctcaccttgcgaaattttctgtcctttttccacgagcactttgatgacagtgcctggcattgatgcggcaatgtgatttggatttgaacggtccgccttcattttttcttgaacggatgatttgatgctttcatccttaatgacgacttcacgaggctgtccatttagctcaaagtaaagaactcttgtggcatttggattcggttctccaattgacacgagtttaacaatgagggtttttcctttttcgatttctacctcaatctcttcaccaagcctcatcccgtagaaaaacgttggtgtgtcaagaacagagatgtctccataactttctgctgtttggacaaattcagaaaagactttcggatataaggcatacgcaattgcgtctttctctgtcagcgtcaggtcatgagattctttaaactgctgctgaatagcttcaaagtcaactggcttcagcttttcaccaggtctaacagtgagcggctcttctccttttaaaatcagcttttgcaatttttcagggaatccgccatgcggctggcctaaatagcctttaaatagttccacaacagaatcagggaagtctaaagttgctcctttttcatagacatcttcctctgttaaatcattttgcaccatataaagtgccatgtctccgactactttagaggaaggagtcaccttcacaatatcaccaaacatgtcattcacacgtctgtacatttcttttacttcgttccagcggtcgccaagcccgacacctttcgcctgctgctgcaagttactatactgtccgccaggcatttcatgctcataaatttctgtatgaggtgaattcatgccgctttcgaattcactgtagtattttctaacagaatcccagtattgagaaaggtgttcgaccgattggacgttcatgtctggctttctttcatgcccatctaaagcatagtacaatgagcttgcacttggctgcgatgtgagtcccgccatagagctgacggccacatcgacaatgtcaacacctgcatcaattgcccttgcataggtgaacagtccatttccactcgtatcatgcgtatgaagatgaatagggattgtgagctcattttttaaagcagtgactaactcataagctgcctgcggctttaataatcccgccatatccttaatacctaaaatatgcgcaccggcagattcaagctctttcgcaagagatacatagtacttgagatcatatttcggacgcgatggattgagaatgtcccccgtataacaaatcgctgcctctgccactttgcctgattcacgaacagaatcaatggcaagtgtcatgcctttcacccagtttaagctatcgaaaatacggaacacgtcaatgcctgcttcggccgattcctttacaaatgctttaatcacattatccgcatagtttgtatatccgacagcgtttgatgatcttaaaagcatttggaacaacgtgtttggcacttcttggcgaagctcttttaatcgctgccaaggatcttcttttaagaaacggtacgcaacatcaaatgtagcaccgccccacatttccatactaaacagctctggccataaacctgctgttggctgggctactttctttaaatcatgagttctgaagcgggtcgcaagcagagactgatgcgcgtccctaaaggttgtatctgttaaaaggacgctcttttgttctttcacccaattggcaagaccctcaggtccatgcgcatctaacaattgtttagtcccagatagaatctcttgcttgagaggaagcttcggtacaacaggcttgtcaaaatgaggcttctttttctccgcaataccagggaatccattaatggtcacgttaccaatataagtcagcatcttcgttccacggtctttttgtttagggaaattaaatagctctggcgttgaatcgataaatgacgtatcgtattccccttttagaaacttctcatgctttgccacgttttcaagaaacggaatgtttgttttaatcccgcgaattctgaattcctgtaagtttcgaaccattttagcagcagcttggtcaaatgtaagcgcccatgtggacagcttgaccaatagtgaatcgtaataaggtgttatgactgcaccttgaaagctgttccctgtatcaagtcgtacaccaaatcccccgcctgaacggtaggccataattttcccagtgtctggcataaaatcatttaaaggatcttctgttgtaacccttgattgaatggcaaaaccatgtgtgaaaatatcttcttgctttggtataccgacttccttgctgtgaaggtcatgacctttcgcgacaagaatttgggtttggacgatatcgacacctgtgatcatttcagtgatcgtgtgttctacctgtacccttggattgacttcaataaaataaaactctccatttgcaacaaggaattctacagtgcctgcattgatatatgatacattccgagccagctgaacagccgcttcgcaaatgtcttcacgcagttgatctgtaagagacacacttggcgccacttcaatgaccttttgatgccgcctttgaacagagcagtcacgctcatataaatgaatgatattgccgtgattgtcaccaatcacctgcacctcaatgtgtttcggattttcaatcagtttttcaacgtatacttcgtcatttccaaaagcggcttttgcctctgacttcgcacggtcataggcttccttcagctcctctttcgttctgacaatccgcataccccggccgccgccgcctagtgaagctttaataataaacgggtaaccgtattcttcaccgaatttttcgacttctttgaccgaatcaactggtccgtcacttcctggaatgactggtattccagcttttttcgcttgttctcttgcctttactttatctccaaacatatctaaatgctgagaagttggaccgataaattgaatgccttcctcttcgcatcgtcttgcaaaatgaatattttcagataaaaatccgtaacctggatggattgcatccacatcatttcgttttgcaatttcgatgatcccctcgatatcaaggtaggcatcaatcggtttttttccttctccaactagatatgcttcatctgctttatagcgatgataagagcctgagtcttctttggaataaatggctactgtacgtaaattgagctccgtacaggccctgaagactctgatagcaatttcccctctgtttgcaactagaaccttttgaattgttctctgtgacatttctcactcctccatatcccttaaaattttatatgtactctataataaaggaagaaatgaaaactgtacacttttgttttctaaagattcaaagttttctgcaatccatttttttgaactggtggtttgctcattgattttttctttttgtaacgctctttatattcagtaaacatgctgatattcagcaatattcccatacaaccgcttagtaaaatgatagatgatcccccgtagctaataaacggaagtgtgaccccagtaatcggaatcaaacctgaaacaccgcctaaattaatgcatgtttggatcgcaatcatggaggaaattcctattgcaagcaaacttccaaatggatcttcacactttcttgcaatataaaatcctttcacgacgatgaagccaagaagagcgagtacaaaaaatactccgaaaaagccaagctcttctgaaatgattgccatgataaaatcggtgtgcggctctggaagatacccgtacttttgaacgctttctcctagacccagtccaaaaaagccgcctgatccaatggcataataggaattaatcaattgatgtccagtagctcctgcatctttaaagggatcttggaaactctcaaaacgcccgagacgattttgcgtgaaaattttatcccagaacagaataataaatggggtcacgacgaccatcacggcactaaataaggccagcagcttcgcaagtgttttcccgctaaaccctgagcataaaatcatcgcaagagcaatcatcccaatgataaaggctgtcccatagtctggctgcaaaatgataaatccgcataagatcgaaacaaccacaattggaggtgtgactcctcgtaaaatatgatcaatataatgctgctttttcgcatacacagcagcaagataaataatgacgacaatctttacaaattcagctggctgaaggctgaatgggcctactttaatccagcttcttgcgttccctgcaatatgaccgccaaagtacacatagatgagggagaatacggatagcagcagcataccgatctgaaatttcttatttgaaaacagctgatatggaacgagtgccgtaaagagcaagatgaccgctccaacgatcataaataaaagctgtttcttaaaaaaattatctggcgcggcatcgtatctaatcacagatgtaatcatacttgagctatacaccatgaccaaaccgaatgcgctaattaaaataatggcgaacaataatgagtagtcatacgattttagcattctctttaacatataatcctcttcctaacgtctgtttctactgcttgatatcctcttagctgtttttattctactacattttctccgtttgatctcgttttacctcttttatattgttcgtcattcatgaaagaatcaagtccgtttgacatgaatcaatgaaaaaaatagaggacaaaaaaactcaaacttatgttaaggaagtttgagttttcaatcactatttttttgtgaacgcatcatgaagtgcggaaagctctctctcaagtttatcgagtagtttcttaccttcatgttgatcaactaatccaagccggacagcaaaatcaatttctctcgataatccgaacatttgagtatctaaaacctcttcataaagaggacattgcggcatcgttaagttgtccatttgcacttggatcaattttaaaattttatctgcatccaattttaataaagccagtgctttttgccgatgatcgactaaaatttctgacgccaaaagtatccctccgttccccaggcgagtacctaattcttctatttatcataaagcgaaacgcccaaaattgcaagcagatttgtacagttcgcttgtaaaaataaaaagaagccttcctccattaaaagatactcatctcgtatttttcactcatcagctcaagcagcttaattccagcaatactattccctttttcatccagagcaggaccgaagataccgatcccaaaatcatatggtgcagctcccataattccgcctgagacaccgctttttgcaggaattccgatgttaatggcaaattctccgctcgcattgtacatgccgcacgtcaccataaaagttttacaaattcttgcgacatcttttgaaagaatctgcttccccgtttctggatgtctgccgtctaatgaaaaaacacaagcaacttttgccaaatccaagctgttcatcatgatggcacattgtttcgtatagacgtccatgacttcctctacgttccctctaataatatgatattgcttcatataatagcacatcgcccggttaatcatggatgtctcaaattcggaggcagctgtttccttgcagtatgtaatgcttttgtcatttgcaagctctctaatgaagctgagcaaccggctcagctgatcttgcggagtcgctcctctgattaaactcgtgactgcgagcgcccctgcattaatcattggattcagcggtttattcggactcgctgtttccagtttaatcattgaattaaacgggtcacctgttggttcttgtccaacaaattgaaagactttttttggcccttcttctgagagcacaagcgccagtgctaatacttttgaaatactttgaagggtaaatcgtttatctacatttccagctgagtggcacgtattactcacatgatacactgccacagataaatccgtctgatccgctttgccgagagcgggaatataggatgctacatgaccatctttggccactttttttgcttcttctacaaatcgttgaagctcttcattgtcgcgacatgccatgcctcatacactccctatctttcatgtatgattagtgtgtacaaggtgcagcatgtttatgaaagtgacaaagcggacgaaaacttctataatttatgttggaaaggggttgtcttgaacatgagcatcattcaaatcaaggggaacgtacagtacaagatcaccattgatccaagtgtatggatttttgatgaccgcaaatttttaatggattcattttttgaaaaaaatgcagcaagtgaagagaatcagctagatcaggagcttgaccaagagcgggtgataagagaaggtcaaactcttccacccacgttaaaaacagagaagaagtacgaaaaggaaagactcgtcacaggcagcttcgggatgaagcttggcgatatgctaaaaaatgctgagccgcttgaacatgcggatacatgcgaatttgtcacagaaacaggtactattgctgtaccactttctcaggcaatggaaagcattgctcatttcagccagcatggtaagccaatcacagaagaaggaccaatccatgtctatttcgcggatcagtccaacctcactcagccgataaaaggtgtcaaagagctgatcattacataagtcaaagggtctggactatagcaaatcagcggcaagctgtgcaagtccagacctttctcctttgacaagcttgacatgtccagatatttgctgccctttgaaccgttcgatcacatacgtaagcccattatttaagctgtctaaataaggatgatcaatctgctctggatctcccatcagcacaattttacttccctctccgactcgcgttaataatgttttcacctcgtgctttgttaaattctgcgcctcatcaatgataataaattgatcaggtatacttctcccccgaatgtacgtcaatgcttcgacttgaatagatccaattcccgccaaaatcgcatcaagctcaccaggcttttttgtattaaataaaaactctaggttgtcatagatcggctgcatccatggtctgagcttttcttccttttctcctggcaaatatccgatatctttcccaacaggcacgatggagcgtgccacgatcaactttttaaacatacctaggtcctctgtctgcattaatccggcagcaagtgcaagcaatgttttaccagtccccgcttttccaatcagtgtcacgagcggaatgtcacgtcgcaaaagcagctcaagcgccatcgtctgttggacgttttttggacgaatcccccaaatatgctcttgatcataaacgagacgctttacatgctctgccttttgatcaagcattcctaaagcagaaccaccttcatttcccttcatgatgacaaattgatgagggttgaatggtgcacttgtgacctcttttattggtaattgattttgcttataaaatgtattcaattgctcagttggaatgtagagctcatgatagccattatcgatgtcttcattttgcaaaacacggtcacttaagaagtcttctgcatgaagccctatagcatccgcttttacccgcactaacacatccttgctgaccaagataacaggcctgccatgaggttttgtttcttcctctaagcttaaatttttcgcgactgccaaaattcgattatcgtttgttttttcaataaaaatttcttgaagctcatgaaaagagcggtgattcagttcaatgcgcagcgtcccttttgactctagtgtaattttttcatgcagtttccctttcgatcttaaaccgtcaattaggcgtgagacgcgtcgggcattttgcccaacctcgtccatgtatctcttttttgagtctacttcttctaacacaacggcgggtatgacgacctcgttgtcttcaaatgaaaagattgaattcggatcctgtaataacacatttgtgtctaatacataaattttactcaggtccttcgcctcctgatcggggtttcattcatcctgtctttcccaaaacgattgttaaaatatatgttttcatgaataaagttagaaggttaattcaacaataaaataaatcatgcagtttgtgaaggagggaatacagatgcgactatttttgacattattcatgattcaagccatcattctgttgggcgcttgccagcagcaggaaaagccagaggcacttgacaagcagcaagatggacgccagcacgtagtacgggtgtcagactcgactaagaaaaagaccaatcaagcccggtcatctacagatgttgcgcagcatcttgtcaaagtgacagagcacgtagcagatgtcaatgatgcaacggcgatcgttatcggccgttatgctgttgttggtattgatgtaaaagatgatttagatagaagcaaggtagaaaacattaaatattcagttgcaaaagcactgaaaaatgatccagaaggtgcgaatgctgttgtggtcgctgatccggatacagtcagccggttaaaagagatgggtaaagaaatacaagcaggtcgtcctgtcagtgggattatggatgaactagccgccattgtcggccgcgtgattccagagatgccgagaaatgaaattgatcgccacgaaacagatccaacaaatgagccgaatgatcagctcaaacaaaacgatcaaaagcagttagacgaacagcaaaacgatcaatcaaaccatcatatgaatcagaagaaataaagagaacggcttatatctcctgtgatataagccgttttctacgctgattttaagtagctggaaaacatgctataataaatgcaataagtgaggtgaaaaggatgagagtgaagtgctcattatgtgagaagcttgaaaccattgatgatgatacactcgttgctaagcggttaagaaatcgaccgattcatacatatatgtgcgatgactgtcaggaacgtattaaagtaaagacagaagcacgcatcaagactggcagattctctctttatcaagatcctgcgacgaaagagaaaaagaagaaaaaaggaaaaaaagaacaaaagacataaaaaaagacctgacacaagttcaggtctttttttacgtattcactgttccttcttttttcgcacgatgcagcctgattttataaataatcaaaatggcagctgccacgactagaccttccgctactggcaggaagatacctagaaatgtgagaaacgtgcagccaaaaatcaaaaacaagtaaatcacgaatgcttttaaaatcggtaaacgtctagcaaagccgagcttaaaaacaataatcgctaaaacaaggatggtaccatataggagccacatccctgtttgcggattttcatcgacacgaaacagcatcgcgaaaaaggatagattttcacttacttcctgatcattcaaaaagattccctccccttacctttaagggttctatctttttaattcttcatggaattacgataatcctgctagctttttcttcttcgctgctttctcacgttcgtttttatctagaattttctttcttaaacgaattgattcaggcgtaacctcacagtattcgtcctcattcaagtactcaagagattcctcaagtgacataatacgtggttttttcatgctcaccgtttgatctttcgtcgccgaacgcacgtttgtttgttgtttcatacggcttacgttgacaacaagatcgttctcacggttatgctcaccaacaatcattccttggtatacttcaacacccggctcaacgaagatcacaccgcgctcttcaacgccttggattccgtaagcagttgctttacctgtttccattgaaacaagtactccttgacggcgtccgccgacttgaccagactgcattggctggtagctgtcaaacgtatggtttaaaataccaaaaccacgagttaatgaaagaaattcagttgtatatccgattaaaccacgtgatggcactgtaaagatcaggcgaacttgaccattaccgttattgatcatgtcaatcatttcaccttttcgtgcgcccattgattccatgatagagccagtgtgctcttctggtacatcaatttgaacgcgttcaacaggctcacatcgaacaccgtcaacttcttttacaataacttctggcttcgatacttgtaattcaaatccttcacgtctcatattctcaataagaatggataagtgaagctctccgcgtccagatacaacccaagcatcaggtgaatcagttggatcaacacgaagactaacgtctgtttgaagctgctgctctaagcgctcttcaattttacgtgatgttacgtattttccttcacggcctgcaaatgggctgttgttcacaacaaacgtcatttgaagtgtcggctcatcaatacgaaggattggcaaagcctcttggtgttcaaccggacaaaccgtttcacctacgttaatgtcttccattccagatacagcgacaagatctcctgcttttgcttcgttgatttccactcgttttaacccttggaaaccaaagatctttgtcacacggaattgtttcacactgccgtcaactttcattaaggctacttgctgtcctacttgcattgttcctctaaatacacggccgatcccaattcttccaacataatcattgtaatcaagtagtgccacttggaattgaagcggctcttcatggttatcaactgggcaagggatatggttaacaatggcttcaaacaaagattccatgttttcatcttgcttgctcgcatcgttacttgctgtaccattgattgctgatgcatagacaactgggaattcaagttgttcttctgttgcatccaattcaatgaacaagtcaattacttcatcgactacttcagccggacgagcaaagtcgcggtcaattttgttgacaactacgattggtgttaagttttgctcaagtgcttttttcagcacaaagcgtgtttgaggcatacagccttcataagcatccacaacgagaagtacaccatctaccattttcatgatacgctcaacctcaccaccgaaatcggcgtgtcctggtgtatctaaaatattaatgcgtgtatctttataatggatcgcagtatttttagctaaaatcgtaataccgcgctctcgctctaaatcatttgaatccatagctctctcagcgatattttcattcgcacggaaagtaccagcttgatggagcaattggtcaacaagcgtcgttttaccatggtcaacgtgggcaataattgcgatgttgcgaagatcttttcgaagtttcacattttcatctcctaaaataattagataactttcatattatatcacaatcccctttaaatgccgatcgtttttctgtaaacttatattaactctaaaaaaaagggatggagacaaatgaaacaaatcaaatggcttctattattatgtgcattacttgcggttgtcagtatggcgtttattgggataactcttgcagaaaaaaacgtgctgggtatttgtctaagtattgtgtttgccatgattttcatgggtacaggatttacattaaaaagaaaattaaacgtgcaatcataaaatttctcaaaagccttttacattctatatgtagaaggcttttattttaggtaaaaacaagaccaaccacctatgaaaggtcgtgtataagacagaacatatcatttagacttggcaaaagtaagccatctgaacctctccatttttcgacaataacgtttatagttctccaaattcaaacataaagttacaattttcctattcttccacaaagtttctcgtggtatgctgttcttgcaacaaaatttaacagaaaagggagagaaaagaagcatgaagaagattttgagcaaatcgctcagctctgttgtatttttcgctttagctattattcttactttcacaacagtagctcctgggcaagcaagtgctgcaactttcaaagggattccttttgagcagcagcaagtcattaaagaattattggagaaaaacgagcgtgtcatcaacattctcatcaactcatttgttgaggaagacaacaactacacatttgatgtgaaaaaagctgttgagctcggactaactgaagaagaagcggcgactgctgagaaattcttagatcgcgcagctgttctgacaatcgttttcagtgagagcgtcactaaaaacgaaaaaggaaaattggtttttgatgcagcgaaagctgttgaacttggtcttacaaaagaagaagcagctaaatttgaaaagctgtttaaatcagtgatcagaattgctgatcttgctggtgatgcacttgttttagacaaaaaaggtaatgttgtcattgattcaaaaatcgcaaaaggtattggattcagctctactgaattacttgttttcaaccaaatgctgaagaaaattcctcaagagcaattaaaatcagtctatgatgcaatccaaattgctaaagaaaaattaagctaagcatgaaaacccccatctggatcgaccagatgggggtcttttatttcagccagttaagaatggtcaactgatcatttcatatcgatagccagttgcgcttcattaaaaagtttcattaaacacaaaaaatcacttcattctcatgaagtgatttggtttattttttattttcactgccttttatgtaatcatgcaagattttttcacaaacggatcgatttccggcgacgatactgtttttttctagaaacgttaggcgttctccgtgtatatttgagtagactgcccctacttcatccaaaagcacacagcctgctgcataatcccacggcgcaagccttaacgtgacgtatgcgtcacttctaccgcttgcgatataagcgagctcaagtgcagctgatccaatcgttctcgtccctctcacatcacgcacaagacgggcgaacggtttagcatcaaaataagggctttcgatcgcccaggtcgggttaatgccaacaatggctttttcaatcgctacatcttttaatggaggaagcagggtatcattcatataagccccttctcctttgatcgcatggtaaagctcgtcatgaatgacgtcataaatgagaccgattttcccaatgccattttcaaatatcccgattgaaatggcaaagttgcgtttttgatggacaaagttcattgtgccatcgattggatcaatgatccacacgactccatccagtgaggtcacttcttccccttgtccctcttcacctaaaatatgatgatctgaaaatgtcgcttgtatcttttcaatgaaaaaacgttctgtttctttatcgatatttgtgacaagatcatttggatttgattttgtttcaattgatagaccttcctgcatggacgctttaatacggcttcctgcttcttttacccaaagctttgcaagacggtcaatttccacccagtttgtcatcagactgtaaacctcttttctatgtaatacctatttgtaatagcatactgatattatgtacgtaaaagcaagaaaaaagcagcttcatacaaaaacgaaccgatgaattggttcgtttttacctcaccttgttttaccctttaagctgctcccattcttttcttaggcgctcaagctttcgtttgctgcgttcgatttggatgtcatctttttgctcgatggcttcatgaagcgtagaaagctcatagtccacctctaatctccacacagcgatgcgattcttcttctcctgtctatacccctgcttcacgatttgcttcatttggtcaacgccccttccagagaatgattcattccttgtcagttttcattaataaaaaattcaattgataagagaattggttcttgcttatatcgtatgaagcgatcgcataaccgcaacgacattctgaaaattgtgtctttacctatttgttatgtaccacaaaatcgttgtttttaaacgctgccctacttcctctacaatctttgatctgacggtgcatctttttttgagcttaacccaagctatgataaaatatgatcagcgaaagaatacaggaggcatactatgagtgaaatgcgttttagagatgaagattttgagacatttacagttgacggtttagatgaacgaatgaccgtattaaaagaaagagtccgtccaaagcttgaagcacttggagaacactttgcaccacttctttcttctattacaggtgacgaaatgtttgtacacgtcgcaaagcatgctagaagatcagtcaatccgccaaatgatacgtgggttgcttttgcaaacagcaagcgtgggtataaaaaactccctcattttcaaattgggctttggaaaacacatgtctttgtatggtttgctcttatttatgaatctcctgtgaaaggcgaatatggtcagttattcgaaaaagaactagataccattcagaagaaaataccgcaagattttgtttggtctaaagatcatatgaaaccagatgtcatgcgtcacagcgaactcgatgcagaacagctgaaaacgctgtttgaacgtgtccaaacggtgaaaaaagccgagcttctttgcggtattcagctgcctagagaagaagtcgttcaaatgaataatgaagaattcttatcaaaaatcgaagatgccttccgcacggtgacttatctgtaccgctttacacaaaaacaatctgtataaaaaaaacgagcccatttaggctcgttttttcttacatacgtatcatggcggactcttctgcctctcttgccgttttcactgcacgataaggagaatacccgctttccttttcaaacgctgcacaatgcgtcttttcttctgattttgatggcacaatctctttaaagcgtttataagtatttaataactcttgcttcgctattcctttttcataggctttttcaacagcttgaaaaaacgaaataaccgcaatcttttcctctgtcgtccagtcgacgtccattggatattgatattccatttacttgtccctcactttaacactcatttcttatttgaacttttattatagcatctgttcgatcagaaaccgattgattttatgctttacattccgatcagttcataatataattcttttgttttatgcaatgaaatctgtcgttattggcacaataatagcaggtatttcgacgaaggtgggaaagcaattgtcacaacatgatacacccttatatactggactaaaaaaacacgcagcaaccaatccagttcaatttcacattcctggccataaaaaaggagctggaatggaccctgaatttagagcattcattggcgacaatgcattaagcattgatctcattaatatagaacctcttgatgatttacactcacctcgaggaatgataaaagaagcacaagatttagctgctgaagccttcggtgctgaccatacatttttctgtattcaaggaacaagcggcgccatcatgacaatggtgatgaccgtatgcggacctggggataaaatcatcgttccgcgtaacgtccataaatcgattatgtccgcgattgtattttctggcgcaattcctgtttttattcatccagaaatagacaaagagcttggcatctctcacggcattacaccagaatcagcgaaaaaagcactcacagagcatccagatgcaaaaggtctgcttgtgattaatccgacgtattttggcgtttcagcagacttaaaatcgattgtagacattgctcattcatttcatgtgcctgtccttgttgatgaagcacacggcgtgcatattcattttcatgataagctcccgctatcagccatgcaggcaggtgccgacatggcagcaacaagtgttcataaactcggcggttccctgacccagagctctattttaaatatgaaggaagggcttatctcaaaagatcgcgtgcaatcgattttgagcatgctgacaacaacctctacttcttatttgctcttggcgtcacttgatgtcgctcgaaagcgattagccactgaaggaaaggcacttgcagatgaagccatccgattagctgaattagcgagaaaccgtttgaatcaaattgatggcattacgtgtattggtaaggaaatactcggttcagcttctacgtacgattatgatccaacgaaattaattatttcaattaaagaccttggtctcaatggccatgatgtggaaaaatggctgagagaaagctaccggattgaagtggagctttctgacctttacaacattttatgtattgtgacccctggtgattctgatgaaacaatcgatacgcttataatggctatgaaagacattgctgcagcctctaaaagtgagagcggcacacaagcggtaactgaagtcctgcttcctgagattccatcgcttgccatgacgccgcgtgatgccttttatgccacaactgaagtggttccgtttaaagaagcagcgggccgcatcatcgcagagtttgtcatggtgtacccgccaggcatacctatttttataccaggagagattatcacagaagaaaatatctcctatatctttaaaaacattgaaattgggctccctgtccaaggaccagaagattcaacgctggaaatgatccgtgtcattaaagaacagaaaccaattttataaaaaagaaacatgcagccccaaatggagctgcatgctttttttatttattcagaggcttcatcacagcaatgacagtgaccacacgttccgtatagtgttgtcactttttcattttcaaattgatcaatggtctcattgcaatcttgacaaataattgtacccacgtacattccccttttcttcattcatgatttgaaagcgtttaatctatttcatacttctataatatgatgtcacatttaagttgtcaacggttaattgtatggcacatttaattattttttatgaatatgtgctcttttcttatcatattgagggaacgtttcaattgtattttgcttcatatcaattctgtaacaattgagtaacaatcgaaaattgtcaaaaaggacatgatacactagagtgactaacaggtaaccagctcctaaaaatgttgggacaaccccaaaagattttgaggtgaatagattgaattttatgaggacacttctcattatattccccatgctctttgtacttagttcatgctcatttgcgtatatcataccgaatcagacagaccaagtcagtcatattcaaaaaccaagaattctcttttttacagatgcagaaaatcttgataaagaaagtccttattatgatgcagtcctcgatttaaagaatgaatacccgaaggaaatgtcaaagatgattgtgaaagaagatcgtaaaggctggaaaaatgaagtagaggaattgccggctattttacttgtaaataatgaaaaagtcatagtgaaggttgaaggaaatgtcagcagcaaagaggatattttatcgcccttatgccacgctttagaccgcgtgaatacaaattaatggtctcaccttgcacttatataatccatatgaaaaagcccctcatgaaatgaggggtttttctcatgcaacgctcaaaaaaaccctctccatcaaggagagggttttaataagttcattattttacgatatggattgggcttccaattgctacttcagccgtttccattgtaatttcacctaaagttgggtgagcatgaattgtcattgcgatatcttcagcagtcactccagcttcgattgcaaggctaagctctgaaatcatatcagaagcgccaacacctgcgatttgtgcgccaatcacaagaccatcctctttacgagtgatcatcttcatgaagccatcagttgcgtcaagagaaagtgcacgtccgtttgctgcgaatgggaatttcgctgcaacgatgtcgattccttcttcttttgcttctgcttcagtgtatccaactgttgcaagttctggctcagagaatacaacagcaggaataccaaggtaatcaatttcagctggctctccagcgattgcttcagctgcaattttaccttcgtaagaagctttgtgtgctagtggtggtccatcaacgatgtcaccaattgcatagatgttagaaacgcttgtacggcattgtttgtctgttttgacaactccgcggtcagtcaattcaacaccaacttgctcaagaccaagctcatctgtgtttggacgacgaccaacagtaacaagtacgtaatcagcatcaactgttttttcttcaccttttacttcgaacgtaacagtgacaccatcagatttttcttcaacgccttttgcaagagcgtttgtatggatttcaacgtttccttttttcttcaggttacgtttaaccaatgagctcatttgcttttcgaaacctggaaggatttcgtctccaccttcaaggatgacaacttctgttccaaagtttgcataagcagtaccaagctcagtaccgatatatccaccaccgataacaactaacttcttaggtacttctttaagcgctaaagcaccagttgagttgatcacgcggtctgtgtatttaaaagtaggcaattcaattggacgagatccagttgcaagaattgcatttttgaaagtgtaagtctgtgctgaattttcatccattacacgtacagagttgctgtctacgaaataagcttcacctttaacgatgtctactttatttcctttaagaagaccttgaactccacctgttaatttgtttacaacagaagctttccactcttgaacttttgtgaaatcaactgttacgttttcagctttgatacccatgtcttcagaatgcttagcattttcaaaacgatggccagcattgattaatgcttttgaaggaatacaaccaacgtttagacatacaccgccaagtgttcctttttcaacgattgttactttttgtccaagctgtgcagcacgaatagcagctacatatccaccaggacctgcaccgatgacaagagtatctgtttcgattgggaaatctcctactaccatgacattacgcctccattaaaattaattgtggatcattcaataaacgcttgatgtggttaagggcattttgcgcagtagctccgtcaatcatacggtggtcaaagcttagggaaagagctaagactggagctgcaacgatttcgccatcacgaacaaccgctttttcagcgatacggccaataccaaggatcgctacttctgggtggttgatgactggagtaaaccattgtccaccagcagaaccgatgtttgtgattgtgcaagatgcacctttcatttcagctggagccaatttaccatcacgtgcttttgttgcaagctcgttgatttcgttagacacttcgaaaattgctttgcgatctgcatttttcacaactggaacgagcaagcctttttcagtatcagctgcaattccgatgttgtagtaatgcttttgaacaacttcatctgttttatcatcgatagaagtgttaagtactgggtactttttcaaagcagaagtaagagcttttacaacgtaaggcaagtaagttaacttgattccttgatcagctgcaacttgtttgaattgtttacgatgagcaacaaggttcgttacatcaacttcatccattaatgttacgtgaggagctgtatgcttagagttcaccattgctttcgcgatcgctttgcggattccgctcattttctcgcgagtttctgggaattctccttcaagaactggagctgctgctgccgctttaggagctgcttcttctttcgcactttcagctgcttgaggcgctgcttcttgagctgcagaaccaccattaacgaagctatcgatatcttcttttaacacacgtccgtttttaccagaacctgcaactttgtaaatttcaatgcctttttcgcgagcatatttacgtacagatggcatagcgataacgcgtttgtttggatcagcatctacttgctcttgtgcgcctgcaccagttgctgctgccgcttcttcttgtgccacttctttcttttctggctcgttaccagcttcagcagtaccttgtacttgagcttcagtttttgcttcgccttcttcttcgctgcctttaaattgaagattttcgtaaccaggtgcatcaaacgtaatgattgtttgtcctacagttgcaactgttccctcttcaacttttaattctaatacttttcctttaacaggtgaaggaatttctacaactgctttatcgttttgtacctctgctaaaacgtcatcttcattaatttcgtcgtttggttttacaaaccacttaacgatctcaccttcgtggataccttctccgatgtccggaagtttaaattcaaatgccactgtttttcgcctcctagattttgttgaatccttgttgtgtatgtttacacggtcttgtaattgataaaggggaagagaaataaattcttttcccctcagtcatttaattaaaattcaagaactttcttagctgtttcaagcacgtctttatggtttggaagccatacactctcagcttgagagaaagcaaatacagtatcaggtgcagctacacgaagtactggtgcttctaggctaaggattgctctgtcattgatttcagctactacgtttgcagcaataccagcttgtttttgtgcttcttgaacaacgatcgcacgacctgttttttcaacagaagcgatgattgtttcaatatcaagcgggcttactgtacgaaggtcgattacttcagcagaaacgccttctttttcaagctcttcagcagctttaagtgattcgtgaaccattgcaccgtaagtgatgattgaaaggtcagaaccttcacgtttcacgtcagctttaccgatttcaattgtgtactcttcttcaggaacttcctgacggaaagagcgataaagtttcatatgctcaaggaatacaaccggatcattgtcgcggattgcagaaattaatagtccttttgcatcgtaaggtgttgaaggaataaccaccttgataccaggctgttgtgcgataagaccttctaagctgtcagcgtgaagctcaggtgtgtgaactcccccaccgaatggagaacggattgtcactggagaatgccagcgtccgccagaacggtaacgcatacgagccatttgtccagaaacagaatctaatacttcgtaaacgaatccgaagaattgaatttccattactgggcggaattcttgtagtccaaggccaattgcaagaccgccaataccagattcagcaagtggtgtatcgaatacacgatcctcaccaaactctttttgcaatccttcagtcgcacggaatacgccgccgtttttaccaacgtcttctccgaaaacgagaacgttttcgtcatttttcagttctgtgcgtaacgcatcagtgatcgcttgaatcattgtcatttgcgccatggcttacttcgactccttctgtttgtaaatttcaagctgttcaactaagttgaatggttttacatcgtacatgttttcaatcaagtcagtgactttttgcttaggctgttcgtcagcttctttgatcgcttgtttgatttgttcttttgcatcttcgatgactttattctcttcttcttcagaccataggcctttgttttccaagaatttgcggtagcgtaccaatggatctttttgctcccactcgttttcatcttcttttgtacgatatcttgttggatcgtcaccagccattgtatgtgggccgtaacggaatgtaagagtttcgattaatgttggaccttcgccattaacagcacgctcacgagcttcagcagttgctgcatatacagctaatgcatccataccgtcaacttgtacgcctacgataccagctgcagccgctttttgtgcaattgtttgcgcagcagattgcttctcaacaggagtagagatcgcatatctgttgttttggacaacaaaaatcgctggcgctttgtaagcccctgcaaagttaataccttcgtagaaatcaccttgtgaagctccgccatcaccagtgtaagtgattgcaacagcatttttaccgcgctttttcaaaccaagagctacaccagcagcttgaatgatttgtgcaccgataatgatttgtggtgaaagtgcattcacatcttcaggcatttggttaccaacaaagtgtccacgagagaacaagaacgcttttgttaatggaaggccatgccagattaattgtggtacatcacgatatcctggaagaatgaaatcttctttctcaagtgcaaagtgagttgcaagctgagaagcctcttgtccagctgttggcgcatagaagccaagacgtccttgacggttcaatgaaattgaacgttgatctaatactcgtgtaaacaccatacggcgcattaattcttttaattggtcatctgagagatccggcattgccgcttcgtttacgacttcgcctttttcgtttaaaatttgaaacgtttcaaactgctttttgatggcatcaaattgctttttgctatcaacaattgctttttttgtttttgcagccattctaaagtcacctcttcctttcttttaacagtcaatttgtcgtgaatccatttatacatacagatataggataacccaaaatacgcatatgactcctgtatataatagccactgggatcgttgtcgaaacattgaatgatcactcgtttttgagttcttctaactgtattaacgatagttcacaaataactaatacaacttctgttaacaaggactagtttacaacaagaaaaatagtccgtcaattgatttaacggctttatttaaataaatgtattcgctttactttttatggtgagctgtatcaatctgtttaacaaacaactctaactgtactagtatagagtgtactactgtactacaatagaaaatgtttgtttttgtcgaaaaataaaaaaagagctgttttttcagctctctttggactcttgatctgcggcttcagacaaagcctgtttatgctcattcaattgctttgtatattgattgaactttttaccttcttttctgactttgctataagaacgattcactgtcttcaacttggatttcagctctttatatcctaagtccttcttttttaaagattgatacaaatgctgatcttgtttcagcgccttttgatattccttgtaaagctggtcatacgacgcatatcttttctcgagcgatttgaccgtttcatctgctttttcttttaaatccgtatcttgtatacgtcccgcagattctttgaccgttttcaattcttttttcgattcatccatactgtctttttctgttttcaaatgttcttctcgtttcgctgcagatgctaacgcctgatcagaaaggcttgacactgtttttgtgtgatcctttgtggtttgtatcatttttttatagagctgctgttcttttttctcatagctttgcagtgtgccttgctctttttcaaaagaggcctctttttcgctcattttcgtcatcgcatcttgcatgtcatgaaatgaactttgacctccgcatcccgtcagcaaaagggtacatatccccgctaaagcagcacctgctttcatgcttcttcttatttgtttcatcacaaggttccccctttatatctccacatacaactataatttttataggcgtttgtgacaaggaaagaggtcattctgatgagccgaagaagatttttttcaagtgataggcgcatgactatacaaatagtgcattcatacatagtttatattacacgcttcgccttcacttatgagaggccgagtgtatttccaaaggaggtcaaaagtatgtctaattatagtcatggaagtatgtatggtggatacggcggttacgggtatggatacggtggcggatatggtggtggctgttgttacccaagttatggcggtggttacggatacggtggaggacgcacattcgctttaatcgttgtccttttcatcctattaatcatcgttggcgcagcattcttaggcggcggtggctgctgctaatggctgtttaagcctctgaccggtctcatagaccggtcttctttatttcattgcatatgttgtgtaacattttatatactttacatacaaaggaaataggagtgaagatttgtgattaccatggaagatatcgtacgggacggacatcccgtcttaagacaaacagctgaagccgtcgagctcccgccgacagaagaggaaaaacagcaattagctgacatgattgaattcgtcaaaaatagtcaagatgctgacttggctgaaaagtatggactcagacctggcgttggactcgcggctccgcaaattaatgtcagtaagcgaatgatcgctgttcactgtgaggatgaagatggagaggaatacagctatgcccttttcaacccgcgcattgtcagtcattccgtcaaaagagcttatttaacgacaggtgaaggctgcttatctgttgatgaagccattcctggatttgtcccgcgatatcaaaagatcagggtgaaggccacaacgcttgaaggagaagacattgatattcgcctaaaagggtttccagccattgtatttcagcatgaaatcgaccatttaaacggcattatgttttatgatcatattcaaaaggatcagccattcgctgagccagacaactctgttgcgatcggcagatcataaattaaaaagaagacccaataacctcagggtcttctttttttattcttcaatcaagcctagatgggtcactgcatagaatatgccgtcttcatctaccggctttgtcacaaaatcagccaaatcttttagttcattcacagcatttcccatggcgacacctgtaccagcaaacgaaatcatctctcgatcgttcagaccgtctccaaaggcaacggtatccttttgctcgtaaggcagtctttcgataactcgtttaatgccttcagctttcgaaccgccctttggcaagacatctgttgacaactcgtgccacctgacaagatcaatttcttcgcggaacgcctcgtattggacttcctcttctgccttacagaataacagcatttgaaaaatctcgttttctttaaagtaagacaaatcatgttcaggatgctctgtttttaaagtcccaatcccctcatggataaacggatgatttggcacagaagccttcatcgctttttcccccatgaaaacaagcggatgatcataacgatctgccgtttcataaattttctccatcagctccagtttaagcggattgccgtaaatgacttctccctcatacatgacatactgaccgttataagcaataaaggagtcaagccctaattcctctaaaataggcttaattaaaaaaggcgaacgcccagatgcaatgaagagatgatggcctttttcttttaataaacgaactgctctcttcgttgattcaggtatttttttatcatgatcatataaagtaccgtcgatatcaaagaagatgacttttttattcatatcccgtctcctgtctcctgttatgtatacccactccctttcatcatacagaaagatttatgctttcgaaaccaattcctatgaaaacgcccatttcccacatataaccatgtaacattcaatggaaacgtcatataatacaagtataaagagagaacggaatacaaggtctaatctcacttcaattcgaaaggaggcgacctgtgatgcttcgtcgtctgcgcaagaaaattagaagacaatggaaggacatgcttcgtaaaaaatcgatcgcttaaaaggatcttccgcacatttgctgagggtccttttttctcagagacttttcttatgcgcgtttttttaatataatagaaatagcgagtgtaacatacggtatttaaggagagatttggatgatatataaggtattttttcaggcaactactactgaggtacctgtaagagaacacacagattcactatacgttgaagcggtttctgaaagagacgtacgcgataagttgaaaaaacatagctacaacattgaattcattcagcctgtagacggtgcttttttagactatgaacgagaaagtgaaaattttaaagtattggagctatgagaggaatgaaatttgtaaaaaacgatcaggcggcagtttttgcgctcggcggtttaggcgagatcggtaaaaacacgtatggcgttcaatttcaagatgaaatcattttaattgatgctggtattaagttccctgaagatgagcttcttggaattgactacgtcatccctgactatacgtacttagttaaaaacgaagataaaatcaaaggtcttttcatcactcacggacatgaagaccacatcggcggtatcccttaccttctcaagcaagtgaatattccagtttacggcggcaaactcgcaatcggcctacttcgtaataaattggaagagcatggtctcttgagacagacaaaacttcacatttttgaagaagaggataccattaaatttagaaaaacagctgtgtctttctttagaacaacacacagtattccagattcttatggaattgtcgtgaagacacctcctggtaacatcgtacatacaggtgatttcaagtttgactttacgcctgttggcgagcctgccaacttaacaaaaatggctgaaatcgggaaagaaggcgttctatgtcttttatccgatagtacaaacagtgaaattccagaatttacgatgtctgaaagacgcgtaggtgaaagcattgatgacatctttagaaaagtcgacggccgtatcatctttgctacgtttgcttcaaacattcacagacttcagcaagtgatcgagtccgctgttgccaatggccgaaaagttgcggtgtttggacgaagtatggagtctgctattgatattggacaagatcttggctacattaaatgtccaaaaaacacgttcattgaacacaatgaaatcaaccgtctaccagcaaacaaagtgacgattctttgtactgggagccaaggtgagccgatggctgctctttctcgtattgcaaacggcactcaccgccagatttcgattaatcctggagacactgttgtcttctcatcttcaccgattccgggtaacaatattagtgtaagccgcaccattaaccagctgtaccgtgctggcgctgaggtcattcatggctcacttaataatattcatacatctggtcacggcggacaagaagaacaaaagctgatgctccgtttaattaaaccaaaattctttatgccgattcacggtgaataccgcatgcaaaaaacgcatattaaactggcgaatgattgcggaattcctgaggaaaactgctttatcatggataatggtgaagttcttgcactaaaaggtgacgaagcaagtgtcgctggcaaaatcccttcaggaaacgtatatatcgacggaagcggaattggcgatatcgggaatatcgtcttaagagaccgacgcattctttcagaagaaggtcttgtcattgtagtcgtcagcatggacatgaaagaattcaaaatctctgctggtcctgatctcatctcaagaggctttgtctacatgagagaatctggcgacctcatcaacgacgcacaagatctcatttcaaagcatcttgaaaaagtaatggaacgtaagacaactcagtggtcggaaattaagaacgaaattacggacacacttgctcctttcctttacgaaaaaacaagacgccgcccaatgatcttaccgattattatggaagtgtaatcaaaaaagagacacaagccgactggctgtgtctctttttttcatcaagtattaaaaaagccgcatatatacatcgtacacatgcggtttctcactttttatgattgaattgggaggtgctgaaagcttctgacatcaaacaagccctttgtcgtcattttcacatcaggaatgactggaagtgccaagaaggacagcgtcaaaaacggattaaagtctaaggaaaaaccagtttcttttagcgcttcatgaagtgtatgaaggctttcattgacgagatgtgccggctgatctgacaacaaaccagagattggtaatggcagcgtatgaagtgactgcccttctttcacaacagtcaaaccgccgcctgcttcttttaacgcctcaatcgctttgatgatatcagcatcatttgtaccaactgcaattaagttatgtgaatcatgtgcaactgttgttgcaatggcgccctgtttgatgccgaagccgctgacaatccctacgcccatttcagataaaccttgatgacgttcaacaagcaccattttcaatacatctctgcctgtatcacttgtaaattgtccgttcatttctgaaggagagacttgttctaactttgtttcaagctgattcggaataatacggatgacattcatatgttgatcgcctgtgataggcagtgcaatgtcttccttttgaacatctacggcatgaacagattgtaataatgccgggctcggtgcaatcttttcgacactcggcttatactctccgttctgtgcaaccaatcgacctgcgataaatacacttgtaatgtctacatgatgaaagtctgagacaagcataaaatcagcatcatagcctggtgcaatggctccctttgttttaagaccaaaacactctgcggcatttaagcttcccatttgataggctaaaaatggatctaagccttcttttatggacatccgtacttgctcgtcaatacttccctgtgccattaaatcatccaaatgtttatcatctgtacaaaagaaaaagcgtctcgcattcttctcattcactgcgggtaaaacatttttcacgtttttggcaacagatccttctctcagcatcacatacatgcctcttttcacacgctcaagggcttcctgtgctgttgtcacctcatggtctgtttggacactcgctgtccggtagacgttgattaatcgatctgttaagcctgctagatggccgtcaatcagtttattctcgttttgagtatcaagcagcttttgaagcatatcttcttctgcctgctccacaccaacatagtccatcacctcagcaagaccaagcacttccttttcttgataaagaggttttaaatcttgcgcttttaacgtagcacctgatcgttcaaaactgactgccggtacacaagatggcagcatgaaataaatatgtaaggcagctttcctcgcttcttccagcataaaacggatgcctgttatacctgacacattggcgatttcatgcggatctgttacaacagttgtcacgccgtgaggaacgacagctttggagaattcagcaggggtcaccatagaagactcgatatgaacgtggccatcaataaaaccaggcacaagcatttgacctgatgcatctagctcctgttctccttcgtactctcctatcccaacgatttgtccattttcaacagcgacatctgcatctatccattcctggttaaacacatccatgactttcgcatgtttaatcacgagggctgctttttttctctttgctgctacctcaatttgatgtctgaaaagctccttatccaacgacactgcctcctccaagtaaacaatataatgtttcttatcgtaaacgaatctgtttgcccagtcaatgacatttagagaaaatcaaccatatcaaaacactgatttttatttctgaatagtgataattgcatgaaaaatattacgacttatttttgcggttatacagaacaacgcagcccttttcagtgtctatttccatctcaatgtccacctgtcatgaacacattcatataaaaaaacaccccgtcatcggagtgtttaataatcgttctgcatttctcgtttttcaaagcgtcctatatcggctactgccccaatgacaatgaggatatcttctttttgaatcatttcatcagccagcggggaaacaatgacttcctttccgcgcttaatcgcaacaatattgataccgtatcttgccctaatatcaagatctaaaagagaatgccctgcaagcctgttgtttgcaacaatctcaatcaggctgtactcatctgacagctcaaggtaatcaagcacgttatttgaaatgattttatgtgcaatccgtctccccatatctcgctctggatgaacgacgcgatccgctccaattttgtttagcaccttttcatggtaatcattttgcgctttcactgtgaccattttgacgccaagctctttcagcataatcgttgttaaaatacttgcctgaatgttttcgccaattgcaacgatgacatgatcaaaattgcgaataccaagattttttaaaacgttttcgtccgtcgaatcaccaatcaccgcatgtgaggcaattttcgcgtactcgtttactcgatcttcattcatatccattgccatgacttcaagtccttcttcgctcagcgccttgcaaatacttccaccaaagcgtccaagaccaatgactgcatattcctttttcatgttcagactccttttatctcacttaccatgcattttactacggtttgattaatgaatccatatgtgaacgaatttttttgcggaacgcttcacttaagtaaaggtctgctcctttttcgatttcactgcgataatgagctggcggagcgatttcttcgcttttttgaagcacaagaaaggttaaacagtcctcgtaaatttgatcacctattttgacatcgacaaatgctggacgatatgtaccttcataaactccttctcgtttatacaaataacgaatggcatcaaaaggaacttcatataaaacaccctctgtttcgccgccgtcttctaccatatcagctcttgatccatctggcctcaccaatgtaaatctcgtagtaaaaccatttagtacaccaccgccgatgatttgtttaaagtgatgatcgacttctgcgagcttaaacctagcatcatccatgcaggaaccataggcaaaataatagaaggttgatggcttctgctgccaaagttgataagctttccagcaccctctctttatttctttcagcgctgatgccttctgctctggcaaagtgtatgtcacggctgctacccgaccttgatccgtcatgatattgatttcctgcttgtcatacccttcctctagtacgtctatcttattcaacgtgtcagcggttacctcgtacaattccccgaatacagtgcctttttctgcaggaacacacgctggatatccttgacctgtatcgtaaatccttccactcatccaagcggattttgctaatagtttgttttccttcaagtacgtttcgtggtgctcttcatgctgcaatagcgtcccatatacaaataaagcttttaccgtcatgacttcacgtcctctcaacttgctgctgtctgcttttttgacacacaggcaaataaatatgaaaagctgtgcctttcccaagctcacttgacacgtccattcttccgtgatgatcttttaaaattgtcgcacagatggtcagaccaagccctgtcccttcttttttcgtggaaaagaaaggatcatatattttttgaatatcttcttcagacatcccttttccttcatcttgaatggtaatcttccattcattcaatactttttctgtagatatgtatatgctgccaccttcaggcattgcctcaatcgcatttttgattaaattaatgaacagctgcttcatttggttagcgtctgctaggattgcgccggcatcctgccttttaaatggctgcttgagatcaatatttgaaagaacggcatttgtttttaataaagtaatcacttgttctagaagctcatgaagctggacctcttgaaaatggaccgattgaggcttagccaatacaagcagctcacttaaaacaaaatcaatccgtttaatttcagaaaagataatgtcaaaataatcggttctttcaggatattgagtcttcatcagctgcaaaaaaccattaactgatgtcagtggatttctgacttcatgggcgattccagcggctatttgtccagcgacggccagcttttgcgcctgcatttgcaattgctgattggatctttcaagctcaagctttgcctgcttttgtttcgtaatatcagctaccgttccaattcctccggtaaactggtgatgctcatcaaaataaagcttgtaatgaacatctccccacaccttctttccctctttatggagaagctgcagttctacacgccccgcatccttatgctccttgatcacagacaataaatgctggaccacgcgttcctcttgatcaaagtactgattgtacatggtacctagacattcatcgatgtcatagcccgtcatttgtgtccatgcttgatttaagaaaataatttcacctttttcgtttgtttcaaacacgatttcttgcaagttatctgtgattcgattcagccgctctgtcagttcgtgtgcttctttctctctcgtatttaagtctgacacaagtagatttaagcggtctacatagcctgagacaacccagattcctgttagaaccaggactgtaaaggctagatcgagcggccaattaatttgatagccacctagataataaaagaaatcccagcttaaaattaaaataaatgcaagaacagataacaagatccgcacttgatatgttttgttcaaatgattccacctgccgccctgagattctttgtcaattgtaccattttccacttgttttttgagggagatggggcatttttaaggaactttttcagaaaaaaagcctgttctcagcacaaaggaagagatcaggcttttttcattactgctgaagagcttcttgaagttcttttaacagtaattctgcgccttcagcgcttaatgtaatttgaccatttccataatcatggttctctgatgtaatctcaccagtcatgaggcaaacaccctctggctgatattttttcaagacgattttatccccatctataaaaaattccatactgtctttaatagcaatatcaagtgctcttcttaattcgattggcatcacaatacgccctagttcgtctacttttcttacgactccgatagatttcaaattcgttccctctttctttcattagctcaagatcaatctgtttttcaccaattgatatatcgtagacgtaagagattctcaaaaggtttctcttctataaaattttttttcacaaaagaaaaaacaaagggaaaatttattgtgattgtcaaaatgatactcgaattttacaagttcatttcaaggtcatcacaaacccccacaaatgacctcaaccctctgaacttttaaatgtaaaattgtttaaaacagcaaaaatagagattgggtgaaaacatgtttcaaaatgccgaaattggaattgatttaggaacagctaacatattggtttatagtaaaaataaggggattattttaaatgaaccgtccgtcgtggcagtcgatacagaaacaaaaactgtacttgcagtcggaacagaagcaaaagaaatgattgggaaaacacctgggaaaattgtggcgatccgtccaatgaaagacggtgtcatcgctgattatgatatgacaacagatttactcaaacaaatcatgaaaaaagcaggaaaaaatatcgggtttaccttcagaaaaccaacggtcgtcgtatgtacaccttctggttccacagctgttgagcgccgtgccatcagtgatgctgtgaaaaactgcggagcaaagcacgtgcatttaatagaagaacctgttgcagccgcaatcggtgctgatcttccagtagatgagcctgttgcaaacgtcgtagtcgatattggcggaggaacaacggaagttgctatcatttcgtttggcggcgttgtctcttgtcattccattcgaattggcggagatcagctggatgaagatatcattacctttgtgcggaagaaatataacctattaatcggcgaacggacagctgagcaggtgaaaatggaaattggttatggtctcattgagcatgagccagagtcattagaagtacgtggacgtgatttagtgacaggtcttccaaaaacgatcacacttgaatctcatgaaattcaaggagccatgcgagagtcacttcttcatattttagaggcgattcgtgccacattagaggacagccctccagagcttagtggtgacatcgtagaccgcggcgtgatcttaactggcggtggcgctttgttaaacgggattcaagaatggctctcacaggaaattgtcgttccagttcatattgcagcaaatccacttgaatctgtcgcaatcggaacaggtcgttcactagaagtcattcacaaattgcaaaaaacattaaaataatcttcttgttctacttctttttttatcatttcgatcatatcgtgaggaatggataaacgtgaaggaggaagaacatgttgcttgatttaggtaaacgggttgttgtcacagtcattttaacgggtattatcttaggaggaatgagcctgtcattttcacatatgcccccttctaacgcacagcctgtgaaacaactgaaccgctaaaaaagccgcatgaaagcggcttttttattttggcttttcgcgcgtgctccccattttccttttcggtcttaaatctgatatgatgaacatgactaaaggagggtttttttatgagttcatttgaaaaacaactagatcaatatgcgaagaccatcgttgaagtcggtgtgaatgttcaaaaagaacaagaagtcatcgtatctgcatctactgaatctgcagaccttgttcgtcttgtcgcgaaacatgcatatgagcgcggggcgaaaaacgtacatatccgctgggctgacggtgttcttgctcgtttaaaatatgagcacgcaccgcaggatgtgtttgagcaattcccagaatgggaagcacagatgatggaaaccatcgcaaaacgcggcggcgcttttatcacgatcttgtcagaaagccctgaccttctgcgaggcattgattcgaaaaaaatcgctgcacagcaaaaagccgctggatctgcccttcatacatatcgccaatacgttcaatcagacaaagtggcttggacggttgtaggcgctgcatcaaaagattgggcgaaaaagatcttccctgaccataaagatgaagaagctgtcgctttattatgggaacaaatctttaaagtcgctcgcgctgatcaagcagatcctgtggaggcttggaaaaagcacgatgagtcgctaaatgaaaaggtcaaaatcctaaatgagcgccactaccacaagcttcattatgatgctcctggtactgatttaacgattgagctccctgagcagcacatttgggtaggtgccggcagcgtgagtgagcgcggcgtctctttcatggccaacatgccaacagaagaagtttttaccgtacctaaaaaagatggtgtaaatgggacagtctcaagcacaaaaccgctcagctatgcaggaaatatcattgatgagtttactttaacatttgaaaatggccgaattgtcgatgtgaaagcgaaggaaggcgaagacattttaacttcgctcgttgaaacagatgaaggctctcattatctaggtgaagttgctctcgtaccagatgattcaccaatctcaaactcgaatattctctattacaataccctttatgatgaaaacgcatcgaaccaccttgccatcggcagcggatatgcgttcaatatcgaaggcggaaaagagatgaatcgtgaagaattggatgcagctggtgtaaacaacagtattacacacgtcgatttcatgattggttcaaaggaaatgaatattgacggtattacaaaagacgggaaacgcgaaccgatcttccgtaatggaaactgggcgatttaaccgaaaaaaagacatccacaaatggatgtctttttttatttacgcataaagctcaacgagtctcttttgaatctcttgatctgataagaactcatcatatgttgtttgtttatcgacgatgccatttggcgtcacttcgatgatacggtttgccactgtttcaacaaactgatggtcatgagatgagaagagcatcgctcctttaaagctcattaaaccgttattcagcgccgtaatggattctaggtctaagtggttcgtcggctcatctagaagcagtacattcgctcctgacagcatcatttttgataacatacaacgaaccttttctcctcctgataagacgcttgcttttttctttacttcttccccagagaaaagcatacgtcctaagaatccgcgtaagaagctttcgctttgatcattaggagaatactggcgaagccaatccactagatcgacatcgtttccttcaaagtattcactattgtctttcgggaaaaaggcttgagatgttgtgacgccccatttatatgtcccgctgtctggctccatctcaccagcaagaattttaaataaagtagacacagcaagctcattacggcttaggaacgcaattttatcctcgcgattcataataaagctgacgttatcaagtactttcacaccgtcaattgttttcgatagaccttctacttgaaggacatcattcccgatttcgcgctctggcgcaaaatggacatacggatatttacgtgaagatggcttaatatcgtctaaagagattttatcaagcaatttctttcttgacgtcgcttgcttcgatttagaagcattcgcactgaaccgggcaacgaactcttgaagctgcttaatttgctcttcttttttcttatttgcatcttggctgagtttcagcgctagctggctggactcataccagaaatcatagtttccgacatatacttgaatttttccgaagtctaggtccgcaatatgtgtacatactttgtttaagaagtgacggtcatgcgaaacgacgatgacggtattttcaaaatgaataaggaactcttccagccactggatggcttgtaagtccaagtggtttgttggctcatccagaagaaggacgtcaggcttaccaaataaagcttgggctagtagtactttaaccttttcagaaccaccaagctcagacattttcttcgattgaaggctctctggaatgccaagaccttttagtaagatcgctgcttcactttctgcttcccagccgtttaactcagcgaactcaccttcaagctctgctgcacgaatcccgtcttcatctgagaaatcaggtttcatatagatcgcatctttctcctgcatcacatcatataaacgtttgtgacccatcatgacgacttttaatacttcaaattcttcgtattcaaagtggttctgttttaagatcgctaaacgctcaccagggctcatatgaacatcgcccgtctgagcctcaatttcacctgaaagaatctttagaaacgttgatttcccagctccattggcaccaattaaaccgtagcagttgccaggagtgaatttaatgtttacttcttcaaatagtttacgatcagcaaaacgtaaactaacattatttactgcaatcatttattaatcctccatcactcattcatcattatgaagtataacatgaataacgtttgatagaaacgtctctcactaagaacgaaggcaaattgtccaatatggtataataagtgggaatgatttattgaaggagttcgtgcgatttgagattacttacactgatggaatactgtttattgattttctttatgggtatttatttatctgcaacaggatttaatgcgagtgatttcggcctttatattgggcttgtgcttatttacacactggtacacatcttttcgaaacgctttttacaaaaacgagggaaagaaaatcataagatcggattgtttcggtccgttttagctattactggctctgtcttcgcttctgtgctggccattgtgctcattgttacagtgctcacgccaaattaaaaacgaccctatttttaagggccgcccatttaagcacttttctcatgcacctgagaagggtgcttttattttgtttgccgaatgtcgccaaatgggaagaaaacaaattctgatgtcccgacaacccgatcattttcaatgagtccaaggccatttctgctgtccatggagttgagcctgttgtcccccatcacaaagtaatcgtttttcggtactttcactggaccaaaatcccctgtcaaatgcacttcatactctttcgcatgtgccttgttctcttttaaataaggctcatctacttttttaccattaatgtaaagcgtatcatccttcatttcaatcgtgtctcccggaagaccgatcaatcgttttacataatgaattttctggccgtcttttccattaataatcacgatgtcacctcgtttgacaccacctagatagttaatggttttgttgacgaacagcttttccccatcatgaagggtcggttccattgactctccttccaccacatacggctcaaatataaacgtacggatgagcaagacgagcgcaagtgcaattaaaatggctttgatccattcaaacagtgaacttttcttctctgttttggcttgctttgcatcagattgaatatcattttcgttttgtttgttttcttcgttcaaaatactgcttcctcctaagactttctgctaaaagacttgaaacgtgaattgaataactttactttatcacatgtcatttaaaaattcacaagacaaccattcaattagatattttttcctaatttgttcgtaattaaacaaaaaagaaacaccgcttttcacgatgcttctcctctgaattacgcttctagtttcactggttttttcaaaataccaagtaaaatcgctgttacaacggcaccgattaagatgctgatgatataaagaattggatgatttgttacccagaaaacgaatagtccgccgtgcggtgcaggaagcgtgactctaaagaattccgttaatccgccagccacagctgctccaatgacagctgaaggaatcacgcgtagagggtcagccgctgcaaacgggattgccccttcagtaatgaaggcagctcccatgaagtagcatgtaatccctgcttctcgatcacgttttgagaacttatttctaaagattgttgtcgcaagtgcaatacctagtggtggtaccattccgcctgccataatggcagcgtgcggtgcatagtttccagcagcaatcatcgcaagaccaaatgtgtaagccgctttgttaattggaccacccatatcaatcgccatcatacctgccaaaataatacccattaagacaaggtttccagtacctaaagtttcaagccaatgagttaatccgtccatcaccatttttactggtgtgttcacaatgtaatgcatgatgatacctgtgaagaaaataccgaacaatggatacagcagaactggcttaatcccgtcgagtgactgcggtacaaatgtgaatacttttttaagtaacacaacgacataaccagcaaggaaaccggcaatgagtccacctaggaatcctgcacctgctgctgacgccataaatccaccgaccatacctggcgcaaaacctggacgatctgcaatactcatcgcaataaatccggctaatacagcgacgattaaggcaagcgcattatctccgccaattccttttaatacagctgcaaatgaattaaatgaagggtctttaggatctgctgagttaattccccagaagaatgaaattgcaacaaggataccgcctccgacaacaaatggaagcatgttgcttacaccgctcattaagtgcttgtagaaaccacttctacctttgccagatgactcatgttcgtcttttgaagaactgccgccagagcctttatagatcggtgcatcttgattgactgctttttcaatcaattcctgcggacgacggattcctgctgtcacaggcacttcaatgacatgtttgcctttaaagcgttccatttcaacttgcttgtccgctgccacaatgatggctggtgcttcttcaatttcttttgcggtaagagcgtgtttaataccaccagagccgtttgtttcgactttaatgtcaacgcccatttctttcgctttttctttcaaagcatctgctgccataaatgtatgtgcaatacccgttgggcaagctgttactgctaaaatcttagcaggtttacctgctggagctggttcctcttgaacttcctcttcttcttcatcgtccttgtcatgcgtattgatgatatcgatgatttcatcttcagtagccgcttcaagaagctgctttctgatttcttcacgcatcagaagtgttgataaacgagaaagtgcttctaaatgcgtgttgtttgcgccttcagttgctgcaatcataaagacaagatgactcggctgcgcatccagtgattcataatctacaccagctgtcgagcggccaaatgcaatagcaggctctttgacacttgctgttttagcgtgaggaatcgcaattccttctccaataccagtagagctttgtttttcacggttgatcaccgcttctttgtagccctctttatcatttaacttgccagctgtatctaaaacagtgactagttcttcaatgactgcttctttctgctggctgtctaattgaagcttaatggtctgctttgtgagtagttctgttattttcatggtgactcctcctttaaatgcgtgtgacttttacttgtggtaatagtgtgtcaacaagctcttttgtcccaagctcctcagaaaatgctgtagcactgcctgatgtgacgccaagcttaaatgattcttcaatcgaaaggcctttcgaaacgccggctaaaaatcctgcaacgactgaatcccctgcaccaaccgaattaacaagtgtaccctttggaacattggactgataaatcccttccttactgaataagagagcgccattaccagccatggatacaataacatgttcagcaccttgttctaacagcttctttccataaggaatggcttcttctgcagtagagatgctcgtctcaaacatttcacctagttcatgatgatttggcttcattaagaacggtttcaagcctgctgctttttttagggcttctccagaaatatcaaggacaactctaacgccttgcttttcacatacctcagcaatacgttcatatgtgttatgaggcaatgaagaaggaatgctgccagctaacacaacgacatctccttcaatcaatgaagtaaattgagacagaaacgactcaaattgtgcttcagtaatggatgggccgagtccgttgatttcggtttcttcacctgtttttagtttcacattaattcgtgtatcttctgacacctcgtgaaaggctgtttgtaattgttcgttttgtaaaaagtcttgaatatatttgcctgtaaatccgcctataaatccaagcgcttttgattccacaccgtgacgttttaaaagccttgagacattgatcccttttccgcccggatattttttgtcataggttgaacgattcaaaccgccgactgcgaaatcctccacgtgtacgatgtaatcaactgatgggtttaaagtaactgtataaatcatgttttcactacctttataaccgttttttcatggtaattatcgaatgaatcttcttttgcgtcgtttgtgataatggtggcttcctgtaaactagcaaaggttgaaaacgatatttcgccaaacttggaggcatctgttaagatataggttttttttgcctgcttcatggccctttttttcatgagcgcttcctctggatcaggtgttgtaaatcctgcctcgggatgaatgccattcgtcccaacaaagcttttgtcaaaacggtaattttccatcgccgtcaaagctgcggcaccgaccatggctcctgttcgatgtttcactgatccgcctatcaggtaaaaagaaataccttttctcatgagtgcttcaatgtgcataacaccgtttgtcaccacaacaatatcttgatctggatcgatatattcaatcatttgctgtgtggtcgtaccagcgtctaaataaatacaatctccctgttttaaaagtgaagcagctgcctccgcaatcaatgacttttcttgaaggtttttggcagatttctcaaatacatctggttcaagacggatacttgatatcttggctgctcccccatggaccctttttagaaatcctttttcttcaagggctgataaatcccttctaatagtagattcagacgcatccgtcataatcgttaagtcctgtattttgatgacatcattttcttctaaacagtcaataatgagttgatgtctttccggtgttaacatggaaacacccccttttgaaaacgtattcattttgcgcgcacctttattgtaatcgcttttttcaacattatcaatacaaaacaatcaaatacattcaataactatcaaaatctttcaccatggtcatcttacctttatatgtaccatttgtaaactgaaaaatatgtgacattaagatgaaagtcatgatcttagcatttctatcatttttcatttcattcaatagaactaaaaaaagcttttatgcgatgtgcataaaagcttttgatccttgattacagcggaattcacactgtttgtatgcttttggttcttctcgaaattattcgtatctaagagaatcaataggatctagtcttgctgctttattcgcaggaattaacccaaaaacaatcccaattagcatactaaacagcacacctacacagatgatttgccaagatactaaggatggccagccggcaatgagtgatactaacgaggcaccgcctatacctagtgcaatccccatcaacccgccgatcaaggttaagacgacagactcaattaaaaattgaacgagtatttgagccctcgttgctccaatcgcttttcggataccgatttcccttgtcctctctgtcacagaaacaagcataatattcatcacgccgatacctccgacaagtaaggaaattccagctattgagccaatgattgttgtcatgacagacgtgatttgaccgatgccttctgcgatttcttccatgttgatcatttcataagcatcttctgtatgatgattctcatttaataatgcagccgcattctttcctacttccttcatttgatcagcatgtgcgacttgaattgacaacttatcgtattcactgatcccaaatgtggaggtgagcatggcgaatgggacatatatttcattcatatcgaatgaaagcatccctttttgtttggctaaaacaccgatgacttcaaccggctgtccgttcatccaaatcatttcgcccaatgccttctgtccattaaataattctttttgtaagccttcagagataagggcggctcttctgccgcttctaaagtcaatatctcttaaattctgtccttcggctatttgtaatgaatgtacattcgtatacccttcatttataccgttaactgtcgcatccactgtcgtatcttgaaatctcagctgcattccttgcgcagtcgaagatgcaacctgattcaccccattgattgtcttaatgcttttgatgtcttcctcagtaaatgcggcgtcgaataaagcgttgggatttgcatttaactcttcgtcagagggcgtatacatcatatcaacggtattgtttggacctgaaatcgacccttttagcatttgctcgccgccttgaccgatagccacgaccgcaatgactgatccaacaccaataataatcccaagcatcgttaaaatagaacgtaatttatgagctaaaacagaattcatcgctattttgatattttcaaagagtttcattcatagcgtccccttgtgtcaatctatcttcaacgagtcgtccatctcttacaacgaccgtccgatttgtatacgcagctatttcttcttcatgggtaacaagcacaatcgttgttccttcctcattcagcttcgtaaactgttccatgattgagaagcttgtttttgagtcaagagcgcctgtcggttcatctgctaagataagctgcggcttattgacaattgcacgggcaattgccaccctttgcttttgccctcccgacaactcgcttggcatgtgtttcattcggtctgacaaaccaaccttttcaagtgccatctctgcacgttcttttctttccttttgactgataccagcgtaaatcatcggaagctcaacattacgccttgcatttaacctcggcagcagatgaaattgctgaaagacaaatccaatgaattgatttcgaatcactgcgaggtcttgatcctttgctgctgacagctctctttcttgaaaatgatattgtcctgtagttggccggtctaaacagccaatgatattcattaacgtcgattttccagagccggaggggcccataatggacatatactcgcctttttcaatgacaagatcgatctcacttaatacatcaaatgattcctcggcaacctcatagctttttgtcacgtttgaaagctgaatcattcagcattcacttccattccgtcatacatgtcatctgatggatgagaaatgatttgatcctctgctacgacaccttttgtcacctcaagatcatgacctgacgtttcccctagcaccacttttacttttttaagtacattctttttgacaacataaacgtattgtccatcatcctctttttttacagctgattcaggaatcgttagggcttgacgcttatctgtttcaatttccatgatcattttaaaaccaggttttgcttcaggtttttttccctttatttcgatttcaactggatattgcaccgtttgatcacctgcaggtgtttcggatgctgcctgagcaggtacaacccccacttttttcacgactccttgccagctctctccgcgaatgacatcagacgttatctttactttttgtttcttttttacttttatggcgtcatactcagaaatcaatcctcgcacaaccatttttttctcattgccaatatgaatgatcggctgcctctcttccggctttcctgccccttcttcttgctcaatggaaatcactgtaccatcaattttactatgtacgattaaatcttctatttgtgcttttactttttcttggctgatctctgcttgtttttgttctaattcagccgctttcagctctaattcaagctggtctcgctcgtttctagaattggtggcggattcgccttcttgttttttgtctaattcgctcaatctattttgtaattgttcgcgttttaaagtactggattcagccgcaagagcttgctgctcttcttcaagctccagctctctattttcatatgtaagaagcggcgttccaggctttaccttttctccttcttttacagaaattcccttcaagtgtcccttttcctcttctgcataaataaactgttcttcaaagaatgaaagtgtccctggcgtcatcaccttagtggtgatttctttttgcgagggttttactgttttgatcgctgctgttgaagcaggctttgcttgatttttcgcaatgttaaagccaataaatagaccgataacaataataaaaatggatccgatgatgattttctttctcataaagacattctacccccagcttactgatatggtgattgcagttcctacatattgaaaaatgatagataagagataaaagactcctataatggtccaagctattcttggcgatatatggccaactttcatcaataaaaagcctgttaaaacaaggttccagatcacaaatagatcaatattggcaagcacagcatgccatggaccagacgtttgaatgagtgcatttaatgaggtgattgtgatgttttttggtacatggaacagaatgatggacagatgagaaataatcgtaccaacgatcgtaactggtgtaataaacaggaccgctgaaaacagctgctgaaacgatgcatcaccctttgctaaaaaaacgatgaacttatagattgcagcattaaccacaagcccgagaagtagaccaattagcgtcaccacataaacgaccgataccggcaagcttaaatctgcccacattccttcattcaccagctctgacaaataagtcacaatcactgttaaaagaagtacgcaggataaaggccaccaaaccaccggattttcccatactcttttcaggtgctccgaaggccttgtgctcactccaatgatcgtaggcttttgcatattttctttcatcaaatgtcatcctctctatgtcatgcaagtatgcaaacgcacatgctctctcttattctttctattttatcaaaagattgccaataagtgatggatgatttgattttcttattttcattgagggaaaaattatctattattctattatcatggatgaaatcctccaaatgacaccatgactagaccatattcatatcaataaataaaggtttttctgacctaaaaacattttatcaaaaaaacacatgtctttcggaataaatatccttttcctttgaattcggatggtctttgagagacacaacaattttttgttaaaataatcctagtaatttcaacaaatcccggctttataggactacgattggtttcttttatagaacaaatgagcctttagtaacaatactttcatattaaaaaattaaaaatataatgattttacttgatcaaaagttattttttcatataatgtaaaatagaggtaggttaaatgatagtggaaatggagtcaagtgaatgttaagagaaaaattgaaaacgcaattgattttactttatgaaaaggaacaagaagcatggcaatactttcgaaaggaaagagaactgatttatcatgagctcaaattacttgatatgaaagaaagcagaccctcaaatgacaaaatatactacgctgctagatgtgtagatattattaaagagaaaaagggaagcattgtgagcacaaaagaattaaaagaacaacttcaagcccagacagatttcaatgtgagacgaattagcgaattgtatgatctaatacagcagctcgatcctcacatttctaaagcacgaaggggatgttttatttacgaagatcacacccaaatacctctacaatcttttcacacataaaaaattggttacagccgctggccataaccaaatcctctaatatctattatccaccgcttacaggaggaatgaatgcaacagtgtccccgctacacacttcagcgtttcccctcgtatatcgttcgttgactgcaaccatcacattttgtgcagcatcaacaccatatacctcctgtaattctaatttaatctcatcaaccgttgttcgatctttttgaatgatgatttgttgtttaccggccttctcagcaaggccggcgaacaataatacactaatcaacctgatcaccttctttctttgcaagttgaagatcactaggtttcccctctggatatgaaactgtttcaagctgatcacctatccaggcttccccgtcttcccaatattcttttttccaaatcggcacaatttccttaattcgctcaatggcatattcgttcgcttcgtatgcagctttcctatgaggagatgaaacggctatcgcaactgcaatatccgttatatcaagtgtcccgatcctatgcataatggcagcttcagtatcaggccaccgttttttgatttcttgtccaatttgacttagcatgctttctgccattggtatgtaagcttcataagttaagcgcagcgttttcttaccgtttgtccactctctgaccgtcccgataaacgtcgtaatggcccctgccttccgctttgtcacatgctgaatcaattcattcacatcaatcggcatttttgttattttaaaaagttcactcaaatagagccgcctcccttcaataagttataacaaaatgagttcgcatccttttcaaaggctgaaaacactggaaaagaataattttcggctaactgaaactcttgagaaaaataaatagctgcttgtatattggaaagtgttgaaagttcaatgagctcctcttcattcttcgcacaaacgattttgcggtatggtgcctgtttatacccttctatcaagaccgcgtctaatggaagatgctcacacatattgagcaattgctctaacgtaatgtgctgcattgaaaagtgaaattcaccctctccttctacgccagcggcaaatgcacctgccccgacatatcgatcagtgtctttttctttcaaaagacgatctggtttaccgccatgtccatggtgtttaaagcaacctagcttcagcccatcaagtacagccagctgacagagcttttcaatcaacgacgtcttgccgctgttttgatagccgaccacctgtaatatacttaatgtgtcatccagcatggggaaccctcgccttcgtgctgaaacagcagaacatgcacctgatcaccggccttaaaacctcttgttccacctggcagcacgatgaaacagttagcctctgcaattgaggttacggcacttgatttatcgagacctgttggggttacactgagctgactgcccgtgaattgaagtgctgctctgacaaatcgagtgaacggattggcttttggaaaatcgtgtgtcagcttcgcctcagcaaaatcggggaacggctgtttcttcaaagaccatttatagatcatcggtttcacaaataattcaaagccaacaaaacaggcagcaggatttcctgacaggccaaagagcagttgaccatttggcattgcagcaaccgttgtcacacttccaggtctcatagccactttattaaatagcacctgagctccaagcttctcataaatcgcggggagaaagtcaaaatcacctactgaaactccgcctgttgtgattaagtagtctaccttgcttaaagctgctttgactgcatgaaagcttttgtcaaaatcatcggacacaccgcctaaatcaagcggctctcccccagccttaagggtctgggcataaaccatactaaggttactgtttctaatcttcccgtccaccatcgcatcactcacttgaagaagctctgtacctgttgagatgatgccgatcactggctttttgacaactgggactaccgcatatccaaatgtcgccaatagggccgtaacgcccggagttactttggttccttttttaagcatcacattcccttcaagtacctcttctccttgacgagaaatattgtccccttttttcagcggtcttttaagtgacatatataatttgccctctttttcataggacttagtcagctcaagcatgatgacgacatttgctccatccgggatttttgctcctgtcatgatacggatggcttgaaagggaccgatggtttttgctgagaccactcctgccccaatgtgatcaatgacctcaaattcaatcggatgctcgcttgacgcttctattgtatcttctgcccgcagtgcaaaaccatcatacggggaccgatcaaatgcaggcacatcatgatctgccaaaatgtcttctgcaatgaacctttcaaggctatttcttaagggcacccattcttgttctccatgcttttcatattgatggactttctgaatggcttcttgtactggaattggctgacgtctttccatcacacttcactcctatatccctagcagttttgctagtaatgaattggctgctttttcatcatttgttccatggattaatgcacgtccacctttgaaaaagacaatacgataaggctcatagcggacatggattaagaagtcattcacttccacctcacaaatagatgacagccgctctttcacatgctgaaatgatagattagctaaatccttagatacgacttgaactgtatcccgcccgcaaagaatcgtcgtttttttacgctgctcgtgtaaataaggataggttctatctttgccgcaagatggacagtccttctgcttagtaagagacaaatccattttaaacgttgtcgcctgccaaagatcaaatgtgacaaatttccgttcgatttgatcttcatgtcctgttaaatattttagcgcctctgtttgctgataagcagaaaccatctgaactgctggagaaataatccccgctgtatcacacgtcaagccgccaacaggcagttctgtaaagacacacgataaacacggcgttttatccggcaaaatggtcatatacatcccctgactgctcacacaagcaccatatatccacggcgtcttcgtttcctgcgataaatcattcataaccattctcgtctcaaaattatccgtcgcatcaatgacaatatttgcactgtgaaataacggtcttaacagctcaacccctgcatcttcaatcagggcgtgtatggtcacttcatgattgatctcttggagacgtttttttgccgcagctgcttttggcacatgtgcctttgcatcatgttctgtgtacagctgctgccgctgtaaatttgaaaattctacataatcacgatcgacaatcgtcaacgtgccgatcccagaccggacaagcccttccgcagaggccgttccaagtgcacccgctccaacaattaacacatgactgtcagcaagcgcacgctgacccttttccccaaccggagggaacaaaatttgtcttgaatatcggtcattcaatgctgctctctcctcaccatttttatgtatcatatcataccgttttcaggtaaatcgcttcttttattgatatttcgaaattcgtttggtgttacgttcagttcctcctctggaacgatacgcaccttcagcctttgaagtaactctttcatggctaattgattctcttttaaacacgcatcaatggacggcagacagcggcggtgataaagtgcaaataaaggctgtaaccttccctgaacaagtgggataattgcatctacgttctcgctgcaataggacgataatgcttcggcggtctctctccggatgaaaggcatgtcacatgccgtcactaaataccatgctgcttctttcttttgcatcgccgtatagatgccggcaagcggcccgcatccgcgcatctgttcatcatccaaccacacttctcgttcacctctttctttaaaaaaggtcagaagtgttgaatggctgatgatcaccatctgtcctttcaaaagctgctttttcacatgctcatatagtggttttccttgatacatataacttgcctttggctctccaaaacgtctcgatgctcctccagctaaaatgacattgactacgtccatccgctcaccctcctttgatatggttgttctaatcactctcatttcgcatactttattggtaacatgaataaggagggtctatcgatgaacaggcgccatgcttctcccctattccatgatctatctcaagagaatttatacttaaaagcagaaacagccaaatatcaacaaatgatctctgagttacagtcctcatatacgtattctaaaaacaagaagttaactcaagaatatcacgagatgaaaaaggattacacgcaattaaagcaacaattggatgaattgaccattgatcaagatcatgcagcctcaaaaatacaggatctttcctacagcaaatctgaattattacataaaatagtccttcttcatgaaatgctccaaaaagaaacctttcatagaaggaaagaaacggaagacaaacaccggctgcatttaaaagtcatcaaatataaagaaatctctcaacaattaaatgaacggatgcaggatcaagataaacggcttgcaaaagaggagaaaaaaggaaatactttatccgctgtgattgagaaactgcagcaaacattaagtcataaaaacgcagagctcaatctattacaggaaggcgttagacacctacaagagcggttttatgaaacacaagagaaattactgcaaatcgaaaaagcaaaggaagcgattttttatgaaacgctcataagctatcaaaagcagttagccgaaagcgaggaatggatcgcatctcattttgctgatattgaccagtcagcccaaacaaattcacagccattctcacgagacagcatcctggaaacaacggaagaaatcgaacccatcttgaaaaagctgaacgaacaagttcaaacgctacaagcacaagtcgatgcggtgcaccaaaatggagatgtcatgacagtgaagattgatggcttcaaaaaacagcgtgatcgcctgtcaaaggaacgaaaaattgtctatacagttgatcaaaaaaagtaattatcgcaataaaaaaaactgctggcatgacgtcagcagtttcttttttatttattcgtcttctgtttgaatatcgccttctaaaatatactgtccgcgatatggctttttcacttcaggatacattttaattaagctttgcataaacgttgtcatatttggaatttcaagaccgctctctttttcaatttctttttgaagttcagagcttttaatcgctgcattatgacgctttaacgttttaatcgcagcttcacgaagcttagctgcctttgaaccagggcgagctgtgcctcttctgcgtcttgtagatccttcaggaatacctacaggtgcaccgtttagctgtcctgttcctaaagttgatgcagaatttgattgtgattgtgcaggcggctggtagcttctcatttcttgtgcagccagttcagctaatacaggcagtgaatccgtttttctttctgcacgcacttctttttttgtatctgacactagacctgttccttgacggtctaattctcttaattttgcataaatcgcatctcgctcaatttgatattcacggatgacctttacttctgcttcgtttaattgttccaatcgtaatcgtaacgcttccctctcattaaacaatggatttccccctcatcatataaaaaatattctatagtaaatattagattagaaaactaattttatcaactatttttttatcattttacagtttgttatcagataggtattttcaactaaaattttgccaaagaggaacaatcggcatccatttcattgccactaaaggcttttgacaaaccttaaaatattgtaaaaaatttgaataaacacttatactacttgatttacatcgttatttaccaaactgaaatttcttttgtgcaaaaacgttctgaatagtaaaaagttaaaatctttacattttcatttcaaaacaaaaatgtaaataggtcgttatacctttttgtttcaggaatattttttaataaactccctcaatttctcttttcttaagaaggacaagtccattccgtgcaataggtcgcctatttttgtccatgaaaaaacccccaattatgggggaaagcctattctgcagccttttcagactcagaaagcactcgattgacacgtttctcaagcattttcattccgcttccgccagcttggaagtggcgcagagcacctgttttatcaaacacataatatgctggtacatattcattttcaaaggcttctgttagtttatgatcgctatccacaaaaattggctgggtgatttcatgctctttcgcaacttccttgatcttctccagatttaggtcatcctctgaacgcggcatatgaacggctatcacgtttagttgatccttgtattcatcacggaattgattgacttgaggcattgcctctttacaaagatgacagctgactgaccagaaatgaatcaatgttggtttctcaccaatcaaatcttcttttgttacttctccatttaaccattcttttgcaccagttagttctggcattggttgacgtaatttcattatgaagcgcctccatccattgtatgtgtcgaaacaaaaaggtctaacatcagttagaccctcctgtttcttcagttatcaattaaagtgttttttgaccaggcttccagttcgctgggcaaagtccaccagtttgtaatgcttgaagaacacgtaatgtctcatctacatcacgaccgatattgttgtggaatactgtttgatattgaagttcgccttctgggttgataatgtatagaccgcgaagtgcgattccttcttcttcaattaaaacgccgtattctctagatactgtgtggtttgtgtcagcagctagcggatatttcaattcacctagaccattgtctttacggtctgtgttgatccaagcaagatgcgtatggattgtatcagtcgatacaccaatgatttcagcatctaaatcttcgaactcatcataacgatcgctcattgctgtaatttcagttgggcaaacaaatgtgaaatccattgggtagaagaaaagaactgtccatttgtcattcttcatgttttcttctagactcactttaccaaattccttgttagcaagtactgcttccatttcaaaacgtggagcttgttttcctacaaaacgctctgccatatgtaaatccctccaaaaataatatctttatacagacttctaagctgtatataaaatgagaatcaaaagttgaaattctcatttagttaataacttcacaattacaattataatacttaagcggtttttagtcaatattaattaataataaatttaattaacgatttgtcacaatctcttactccacttaacgaaagtttaacatgtcttgcagaagggaacaaatgattagcttctctattagagcatacatagaaaggttttgaagatcatgaaagcatttgaacaagtagattgggtttccattatcctgaatagcagtatgattttgctaaagctcatcgctattttcgcgatttattttatcatcagagccatcggaaataagatgattaagcgtgcttattctacattctctgaaaagcatgatgtctctttatcaagagctcaaacgctgcaaagtcttacgttaaatattttcgcctacttattgatttttattctagtcgtcatgatcctcgacttatttcattataacccgaccgcattgttagctggtgcaggcgtcgtggggcttgcgatcggctttggcgctcaaggactagtgagtgatattgtgacaggattctttatcctattagagaaacaattcgatgtgggagaatatataacagttgctggttttgatgggatcgtagaacaaattggacttaggaccacgcagcttcgaagttttgacggcacccttcattttattccaaatcgaagcatattgaacgtgagcaaccattcaagagggactatgcaggcactcgttgatatcgagctgtctccagaagagaatgtggatcaaatgattacagcccttcaagcggcgtgtgatgaggtacgagaggacattcctcaaattatcgaaggacctcaagttgtcggggtggaggcgttcggatcctcttcccttgtactgcgcatcattgcaaaaactgaaacaatggagcaatggcgggtagaacgtattttgcgcaaaaaaatgaaagaagtactcgatatagaaaaagagcaaaaagaaccgggatgataagctaccggttctttttcttgtttgttttattgaacacgctgttctacttcttgacaaatttcatcagccgtcataccagacgcggtaatcacagatgcctttgtcgttgtgtctgaaatgccaagaacatttgaatctagtcctgtgacaacatagcagtcacactgatccatttgctgttcattttgaatacgtacgacgtcataccctttttgcttcagtagttcttctacatcggataaagatggttctacaccaatttttgtcataatcaagaacacctcctgttcataaggtgtacaggaggcagcttgattattcattcacctgcttgctttttgaaataagccgtcataacgtttacagctgtttctatcgctttttcatcaggcatgagttttgaatgatgcaggccatattctgaatcgacccctaaccaaaacataaatccagggtactttttcagcatgtagccaaaatcttctcctgtcatggcctctctgcattcaaccacattcgcaagcccttctccagcaacatatgacataaattcctctgtcagttcctttgaattatccacttcgtaataagatgaagggtatcgcacggttaccttgcattcgtagccaatttcaatcccttttgctagtgcttcaattcgctttctcactttttccatagactctggtgaaagtgtacgaatggtgccatcaagctttgcatgctgcgcaatgatattttgagccgttcccccggtaatcgtgccaatcgtaatgaccgcactatcaagaggatcgacattacgagaaataaccgattgcagttgacctacaagtgcactcgcagccacaaccatatcattcgctaaatgagggtaagcagcgtgtccgccttttccttcaagatctatcacaagctcactcgtattggcaaaaagcagccctggctttgtggctatcgttccgacaggatattcaggtgcaatatgcagtgctgtaataaaatctggcgtccactttttcagcacatcacttgtaagcatcggttcagctccgcctggaccttcttctgccggctggaacataaataatagatcttctttgattggctcatgaacgaaatgatcaatgaccccaagtgcgatggtcatatgaaggtcatgtccacacgcatgcatcttcccttcatgtactgattgaaatggataccctgtgtcctcaggaatagacaggccgtccatatctgcacgatacgcaaatacgcgctcaggatttgttccctttactttgacaaaaagtccagttcgccatgtttctatctcaactcgatcttttgaataagcaccaagatgcttgatgaggtatgcttgtgttttgaattccttaaaaccaagctcagggatttgatgtaaatctcttcgaatggatatcaattgctcacgatttaacaagtgaattcgcttcctttcctctatacgaataagacgtggatatatatccacgtctatgtcttcagctgcgaattatatgaattaaagctgacgcagttcttgtttgatttctgttttaccttttgttttttcatcaatgtctttaattttctttgcaggtgtacctgctacaactgtgtaaggctctacatcgttcacaacgatcgcacctgcagctacaactgcacctttaccaattgtcacaccttctagaacaacagcgttcgcaccgatgacaacatcatcttctacgacaactggtttagcagatggcggctcaatgacacctgcaagaacagatccagcaccgatatgacagttcttacctactgtcgcacggccgccaagcaccacgttcatgtcaatcatcgtaccttcgccgatcacagaaccgatattaatagaagcccccatcatgatgactgcattatcaccaatttcaacttggtcacgaatgatcgcacctggctcaatacgtgctttaatgttctttaaatctaacatcggaattgcagagttgcggcggtcattttccacgacaacatcttcaattttgtctttgttcgtttctaacgctttttgaatgtcgctccactcaccgaaaacaactccagtgtttcctgtgatgaacgtttttgcatgttcaccaaactcaatgccttctaaatcacctttgatatagactttgacaggtgttgattttgtactattttgaataaatgaaataatttcattagcgtccatttgtttcatgtatgtatgtcctcctcttaatttatacttcattactgtaccaaaggagagttttaatgacaagtgaaagagttgactcttcaatggaaaataaaacaagcgggactgattaccccgcttcctgctggtgaagatgaacaaattgtttaccaaaagaaatcaatttctcttcttcttctccttctggatttagctcgatcttgactgatggcaggacaatgtccccgccaagttccttcactttttcttcgattagatcaacagctccgcaaaaatgctcataagatgtatccccggaaccgaatacagcaaatgcttttcccgttaaatcaagctcttccatttcttcatataaatcaataaaatcatcaggaaggtcaccatctccccatgtgtacgcacctaacataatgtgcgtgtaatcattgagaagttctgcatcaatatccatcgcttcatgacggtccacgccagctcctgcttctgttattcctttttcaattagatccgccatcgcttctgtattcccagacatcgtggcatacaccagtaaaaccttttctgtcactttttcttcctccttatcaatgaatcaatgccggctcctcatatggccttacaaacttgctttcatataaaccagcacagaaaaagttttcattttgattggctacacgaaaaccgtgtcctttgatcgtatcaaaccatttgagctctttttgctctatatcaagctgatacactttagaaaatccgtattcgtcttgtgaagtagttacatacacaatgccattatcctctgacacatccaaaaatgattcttctctagcaaaggcttgtgattgaatatcatgcagcatattggtatgtaaatctaaaatttgaacagatccctttttgcctttttttgatcccaatgcgcaaacaagcagatgctcttgacagagcagcatagaagctgtcatccggtgctcctctctgtttagaaggaaaacctgttcactctccaagtcatacacccatactcctccgtgaacctcatgaatctgtgttccaatataaaggtgatcacctgcagcacataaggaacgaatgacaggcggatggttcacatgagcaaacggcttcataatttcccaggaaatcccgaaatcatttgacacatatatactatgttttccatgtgcacacacaaacccgtcttcgcgtcctgtaatcgaccaaacgactgcatttgttggaaatgatgatagcgcccatgtatgaccttcatctcctgatctaatcactgtgccattttcaccaacaccgaataaataaggtccaatatagctgatggcatgaattttatgcttgagcttaaacagttgctgccatccgctctccacactatagtgaaagataccttcacgttttacagcaacaaagtatccaccgtttttagaggcagcaacggccgtcgctcctttatgaaacatggttttcaactcgtttcacagatagcgccgcccatgttaaaaagcttgtcgcaaattcctgacagcacgccacatcctcatctgtatcaggtgcaagctccattttcaatgtttcaggaaacacagatgcaccggttgatttgagcatgtcatgaaatgtatggacagcctcacaaaacttcgggtaactgtaatctcctgatccgaacacagctgctttgatgtcacatagttcaagcgcagaaacctcttcataaaaatcctctgcttcataaggtaaatcgccatcaccccatgtataagaaccgatgaacacataatcgtatgaagaaagatcctctgcgcttgtatcatcaaattccatcatctcagtatcgatcccttttccttctagtgtttgctttataatcgctgccatatcttctgtattaccagacatactcgcaaatgcaattagtgctttcatctatcggtcacctcatctaaatgataatcattttcaattattatatgtacactttaaatgataatgattttcattgtcaaatgatttcataaaaaagctttgaccaatcaatactctaacccaatgaaaaacccgctcaatccaattggaaggcgggtttttcgtatcgaagagatcatcggttcctcattcgttcgtttcatctattcgaataaaatatggaccataatccgtttcgtgcgtcatcacaaatgtccatttttcattccaatccatcacatacatatcgttataatccatattattagactgatatggtaaatcattgattaaaagagagctagcattttcgaaaagatacgcctcgtcaacaaattgataaaaaacagtacacttatcctttgattgttgaagaaatgcgtctatcgcctcagccttttcaaggcatgtaaccattccaaaactgcataaatgccataaaaaatcatctactgatatatcgttttgttctttaactgaaagatgactagcaaaacgttcacgccacctggcgcgcaaatgatctccccattcaggtttgttcattttgattaattgattgtttttcataaaatcgaggtctcctctatgattcgctccatctatctattgctttgatatgcgtacaataagtaaattgaatcaagctgattatttacctaaaaaaagcaccttcctcttccaagaaggtgcttacaccgcatcactttcaagcatttctttgaccacaccaacaaatgcttgcacttgttttaattgaaaagaagcttcatagcctagcagccatgtgtcacgtccgatttgttctccattcacgtcaacaagcggtgttttatgaacacttttttcgtggtcgtataaggtgaccgaaggcaaaatggcgtagccgatgccgtggtaggccatctgtttacacgtctcaatctggtccactagaatcgtctgctttggagacactttgaatttttgatgccaccagtgctggatttcctgataatacgtgctgtcgcttttaaattgaataaacgggcgttctgtctcgattaactcgtccacgtccttgataacagaatcgactaaatataaatgatctgtcatcaaatattcctttgttcccttccaatcagggtttccgcgaatgatcccaatgtgcacatggtcctcatataagcttttgagcatttcactactccagccggtcacaagtgataccttcgcatttgggtacttttcgacataccgctttaacactttcggcagccagtgctgtccaataatggaggccaccgcaagctttagtgtaccgtgaatttccccttcaagttcatcgattctctctctcactcgatcttgctcaaccgtcacctcttttgcaaattgaatgatctgttcacctgccgaagttacggtgagccctttctgagaacgaaaaaagattttggtaccccactctttttcgatcgtctgcaatctttgggataaagcaggctgagagacaaagagccgctccgaagcctttctcatattcaattcttcacttagcacaacaagcatatgtaactcttgaagctgcatgggcgtcccctttctctctataagtttttcttattccatatggtcattatataaattatagcttatgaaggcaaaaaaaataagctgggcttcagctcattttttcgcggcatgaatcacttcatttaagcgctttaatacaacacgtcgtgtaaatattccttcaaagacttgctcctcatttacgacacaaacaaatccattattcgttacagcgtgaacgccttttagcacaggatccgttgttttaagccttgggatatcagtgagcataacttcttctaccttcagttggtccagcttttcgaattcaattcgttctaaaccaaagatcttatccataatcatattcgttccaattaacccatgcaggtgatacgaaggatctaatactggaatggctgtatatcctgtttttgtaaggaccaatagggcatgctcaagattatttccaatttgaacatgtgccactttatctgcatcaatcatatgctcagctactgtggactcaagcaattgagttggttctatctctatcatgtttcttcgaccccttttctctcaatcatcaatcatacattcccctttaccattaagcataaactaaaacgaaatttgtcgaaagattttttctgcataaaaaagatactcagctcccgagtatctaatagaatgttcaatcaatattaattctcaaaccttactctgtcatacaatgtgatcaattgcttatacgtattgtcatcgacattttttgttccacattctatatcattgatctcactgcttagtaattcgacagcatattcctgattcagcaatacgtttaataatagctttttctcttcttcattaaaacgattttcgatgacgctcatccaacatcaggccccctgtttcatatatgcttttatattgattagcaggcttttgaatgtctgcttcctctctatacagctagaataaggaactagaatcgaatcgtcaaccgcacgtttcgacaaggtttggagaaaaatgacggaatttattttgtgtatcgattggcatagcaaaatgctgcgtatgagtcgggttttattttagcttcaattcccatagctgtgatcattccggtcatttcctgaatcagctcttttgtacttccttttttgccaatatctagatgagcttcaaaacggaggtctgccccttcctcagcaaagggaagaagcaaatccatcagttctgttaaaggcccctcaaggatgtctgcacataccttttggctaaacgctgtctctaatgaaattttttctctaaggctttgcacaggcctgctgatcacttgttgcgtaagacagccccaagcccctttgccaatccggtggagatgaattgcagtcataaatcttgtgacattttgattgacctgcgagtccgtaccaattgataacacataggcggatctagggtcttttcgaataaagtctttcattctcatgacgacatcagaaaacgctaaatgatcttcagaaagattgtagtaaaaagaatcactcacagaaaggaactcctttttaatggtctcttatccgaatattgcgctgaatgatcatcttccttttgcttatcacctatgaagtgtatgcttccgcaatcaacaaaggaattcttagaaaaaacatttcatacgattcagcttaggattgtagaagctcaaaaatctcaatcgaaatcatatcaatgttgtcaaatgggaaagtatttggcttatccccttgttgaaaaacagtcaattcaaacgtttgattcttttcgaaatacttaacactacagattttctcaccgttcacttcgaaataacgctgtgccggttcgtttgcagcttctgctgtctcttgaagactttgcagccttgtaatgatacccattaattgtgacattctaaaaaaagactcctttcaaaaaaacaactcaagatgaacccgtattgattatacacaagtcctacaaagcatcataccataaagtgttctcagatgatatttttcctcttgaattcaaaaaaagaaaaagaatctgtttttttagtttgagtcttttttctgatctcatgcaccatgtttttataaacccgcagatctcatcagccgtttggcaatttcgtcaaaatcctctttggaaatgcctggggcaaactcttccggtaattctctataatctggcacaggtgctccttgcggggttccctcaatcactgtgagcggttttccatcaatcggatggctgcctttccaaatcttattgatatccttgtaatccgtatcactaaatgtgtacagttttgtatgaatattttggtcttcaaatttccttgctgaatcaaagtatttgttgtcgaggtttgggatcgggagcattttccctacatctactcctgtagctacctcaagcgcctttgcatatgccacaacatgcacaccgccccgcacaagtaaataaccgatcatctctcttgctgtaggatgatctgtcatttcatatacgcgcattttgtgcgtacgagccccgcattcaaggaagaaattatgaaggaggtcaagaatcaggtttccgcttgagaacacattctctccggtccaaggttttgccatggaatcaaacggatagcctgtttgagccgtttgaataaaatgctgtgtatttcgtttatcgacagccgctttcatcggtgtcgtatctggatctccgccatgggtggtccctgtaatcatgagattcacagctgtggtcacaagttctacatgaccgaattcttcagccgtaatactggatacgaggtcataaaacggtttgagttttcgttttcctctaaagttaaaggattgaaacatgtaattatttaatgtggacatttcaccgaattttccgccgagtaattcttgcacagcagcagcaccatttgcatctgggtgatctggccttggcaaatcaatcagcagccgcttgtcacgtttgatcatgacgttccctcctaccgtctaactgtcatcacttaagatgtatggagtgattgggctgtcctatgcatgaggtgaagatgaaaagcacaaaaaaaacttggcgggggtagcgccaagttttttggatcttgatctgatagaggggttggggaacagagagtagcttctctctataactaaatgataatgattatcagtttcattgtcaaccattttttatttctttttttcaatcaaaaaaagcagcctaaaaggctgcttagattgttaataaatggctaatataatcttcactctgtgcgtttaaattaatccatcctgctcatataaataggcatacggaagatctataaataaatacatatctccctctaacgggtaagaaaacgtacgtatcctctcaccagtttctaaatcgctatatatatcactgaaaaatcctttcccgctcattctcatttggagaatattcgctaggaaataaggacgccagctccagtttttctcaatatattcaggctgaaacagccattctttttcttttttaaacacatttccagtgatttgaaagccctcttcattacacatatatatccgaaagctgcaatccgttaattctaatgccagcttttggatgagttcatcatttgtactgcatgatttttttaaggtcgtgacagcttggtgaattcgtttataaaatgtttcagaatgttcgtagacagtttgtagtttctttttctcatgagcaataaattgctggaattcttctctcagctgatcttttcgtttattacggtcgattaattccgccgccggctcgtgaagatagaacccttgaaagtatctgccgccatttctccaagcatattgcagctgaaaatttgcttcaatgtcttcataaattaaagccgcccctatttttctcgcaagcaatgaaatgctgtacaagacatattcataggaaggtgaaggagccgatgctcttaatgcgtgtaaatctatttttaatagatcgggtgagagcaaggcaatccggtcaagattgctgctttcttttccaatattcgagatggcgattttaataccatatgtacgaaaatacgttaacgtatggtaaagctgttcaatatcgccgctaaacgtatgctctgtaaattcgataacaaatcgattaagctgaatgcctcttgcttcatattgcttcaagagttctaaaaagctttcaccatgatcaagcatcaggatattggcatcatggttaataaaaatgagcaaatcatcatctgctgttgtgaaaagatcaagtgcttgcgtcagtactttatgatctacttctactttatattcgtcaggaatagatgaatccgtaaagaaggagcctaggctaactgtttcagactcgagcttcattcttcctaaaatctcatagcctatcactttttgctcttccgcactgaatatcgcttgatagtgcgggaaaacatcttcaatattcgttaaaatatccaatggatcgaccattttcatcacctgcttctctctttgtgtgattataacacatcaaaagcaggtcttacatcgtcattcaaaatggggattggttgagccattgccctccatccattgtaatacaatctccatttatataagacgcttgttcagataataaaaagcttgcaagcgctgcaatttcctctggtgtgcccagtctgccaagaggaacactatctaatgttctttgcgctgcctcttccgattcccatagtttatccgcaccgcctgttctctcgattggacctggcgcgatagcattgacgcgaattcgatattgctttccccattccactgcaagcgttcgagtgagagataaaacacctgcctttgctgccgctgaatgcgccacacctacaccagcaccccatgcataggtcgccaccatattgaccatacttccgcttttcttttgacgaatccagtaattgcccactgcatgactgcaaaaaaatgttccatttaatacaatatcaatgacagccttccagccgttaggagatagtttttctgctggaactaaaaagtttcctgcagcattgttaatgagagcatcaacatcgccaaacgtatctacggcaaacttgaccatttgatcagcatcttctgggtttcgcacatccatttggaagtaagcgatcgagccgccattttgttttatttcatttgccgctttttctaacgtttcttctgttcttccagtaatcacaacattccagccttcatgtgccaaatggacagccatcgccttccccattccgcttgatcctcctgtgacaatcactgtttgtttcgtcatttgttctccccctctgtagttttgaatgactattcattcattattttctatcatatcacgattgaccctagatgcaccatatgggagattctttaaatatgatgctatacttaattttatttataaaggagtcttatatgaagcaactttctcggagacagtttttaaaaggagcagctggcgcgagcattctcggttttttagctacaacatgtgggtacgggtatgccagatacatcgaaccacgcatgatcgataccgtgtcaataaccattcgggatgctcagcttccagcttcatttgaccagtttaaaatcgctcaatttagtgatgttcatttaagtgatacatttcctgcgaaggaattagaatccgtcgtccagcaaatcaacgctgagtctccagacctcattgtattcacaggggatctcgttgattttcaagcatcgattgaagagcatgaaaaagcgaaagcctatttgactaagctccatgccccgtttggtatgctcgcgatatgcggtaatcatgactacggaccatttggtattgatctttatgagaacacgatgaaagcttgcggctttacaatatgtaaaaatgatgtgtttccattagaaaaagaaggggcgcatattcagattgctactatggatgacttgatgatgagtgtgccggattatgacctaatgaagcgggaagtatcatctgatttatttaccttgctgctcgtacatgagcctgatgcagcattggagttgaattcaatccccattaacttgcagctttctggacatacccatggcggacaggtgcagcttcctttctatggacccattctcacagcacctttcggccatacatatgtggaaggtttatacggaagttatcagcaccgcatctatgtcaaccgcggccttgggacaacaagactgccgcttcgattcttagccaaacctgaattaacctttttcaccctctcttctcgcatttagacagaagccaaaccgcttctttttgcatatagataatcaaagatctttctcatgacaaatgttaggagaaaccttccttagcctgattccgtccatatatatatcaagtgacgggcatcatggctgcttttatttgagcaaaaggagtgtcctttggtgctgcgatatacggtaaaacgcggagaaacgctttcttctatagcgcttgattttcgaacaacaacagatgccttaaaggctgcaaacccttcacttcaaggtcaagaaccggtacaaaatgaggtcatcatcattcctggtctgcccgatcctaatacgatcccttaccgcatctctgtttcaatttctaggaaacgtctcgtcttgttttctggatcagagctgattcgatcgtatccgattgcaacaggaagaattttaaatatgacgccgacaggttcttattatattgtgaacagacagccaaacccaggaggtccctttggcgcctattggctgagcctctcgaaagttcattacggcatccacggtacgaataacccctcttcaattggtaaagctgtgtctagagggtgcattcgtatgtataatcagaatgtcatcgaacttgcttcactcgttccaaatggaacacctgtgaccattagccagtaggagaaatcaattgtatgaatgcttaaaattttatatgatataaagtgggatcttcaggttaaggagcgtatttatggatatttttaaaaacagaaattttgttcgtctcttttttgcagcacttgcttcgcaaatggggacaacagtaggcaatatggcgtttgccttttatttgctcgatcattttagtcatcagcccgcctatgccacattagcagagctcatgtattcacttccaacgatctttgtcttttttatggtcggtgtcgtagcagatcgttttgatcgtaaaaaagtcgcagagaattgcgattggatacgagctgggctgacgattgttttattcatcgttatttatttcaattcacttcctcttattttcttgatcttatttatacgaagtgccattacgaagttcttctatccagctgaagcctctctcgttcaggcgattttaaataaagatcaatatgcaaaagccgctggtttaaatcaaatgctgtttagtttattcatggtatttggtgttggaatcggtgcgattatgtataagacaattggacttcacggagccattaccattgatttgatcagttttattgtgtcaggcatcctgattcgttcatgtaacattccaattgaagcacgtcagccaaatggacaagcaggctggagaggtatgaccattaaaacgtctctaaaagattttaaagaaggcattctttacattataaaaaataaattattggcttctttaattttcggcttttttgtttttggtctagtcaatggcgcatttgccgtacttccgatgtttacaatgaaatatggtctttcaccggatcattttgaactgcatacatccttctttacaatcgcgatcggtgcaggcctgcttgttggcagcttaatgggctctgttctcgctaagaaagtaaagatgcaatatctcatgtcacttccaattttggttgcaggcattctgatttttgtacttggttccacccatacactatggttgttttatgtcacatcatttgtcattggtacatgcattggaccggtcaacattgtcattggcggctggctgccgagaatcgtccaccctcgtctgatgggacgtgtgtcaggctgggttgatccacttaccatgtttgctcaatccatgacattaggtttgattgcggtactatttccaaaactcattacaaacgtttcttatatttattacggaatgggcgttattattttactcgttttccttttttacttctttacactgccaaagttcagcagagaagctgacgacttagacgtgcagcgtgaacttaaaggtcagggagcacaataaatgaagcaaaaaggactttcttctatagaaagtcctttttgtatggctctgaaacacaacggcgcttatcttttttgttcttcgaaatgattggaaacaaaatgaatgattctttcaactgcataaatgctaataaataggatgagaaatagaagcaaaggatgaatcggctggtcatctatcacgtacacaatgcatccaacgacaaatgcgaccaataaaggagttaaaatagctttcaatcttaacaatcctttctgttctcatagaatttgatcttcttattttataacatatttttctttttatgaaataaaagggagtatatataaaatcgcagtatttttaattaaaaatctttacatctttgggaattttatagtagtatagtcaggttggaggtgagaggtatgctaaaaagttattattttattcatacaaaagatgatcaaggtcagtatgttgtacatacagaagattgtgcatttttaggtgatgctgcaagccgtaaattgattggtctgcacatgagtggcgagagcgccattgatgaagctaaaaaaatgacgaatgaaactgattttaatggttgcttctattgcgcttattcaagtcataagaaatagaccttatgatgaaaccatatgttcgacatgttgtctggcatatggtaaagtctcaaatgcaaaatgaatacaattgagaaactacccatttatttaaaataggtagttatcatgaactaatagttcactacatatatatttgattcagtcaattattctgcgcttcttgcaatgaacgtctcttcttctttgtccattaacaccaatggcaccatcacaagttatgtgatgaatatacgacacctttagcatatataaatttaaatacgccgcattctttccacctgaagcagatagaagaaaaatcaaattggatagatgctagtgtctttgctgacctttctgccatttttatcttcacccacgttttagaaccttcctgaatggctattgtacataagagggataggaatcctatcgctttttacaataagtctatttgcaatttactaataaaaacgtataatttatactaagcacagaaagacgaaagacaaaggagagaaaaaatggacgattatgctcatactaaagacatagaacctacagcagaaaacatcgcaaaagccatttatactgttaaccgccatgctaaaaccgcaccaaatcccaagtttctttatcttttgaaaaaacgtgcgctgcaaaaactattgcaagaaggtaaaggaagaaaagtgggcctacatttctctaacaatcccaaatatagtcaacaacagtccgacgtgctgattgaaattggagattattattttcacctgccaccaaccaaagaagacttcgaatttttgccacacttaggaaatttaaatcaatcatatcgcaatccgaaagcgaatatgtcattaaaccgagcaaagcagctgcttcaaacgtatgtcggtttaaaagaaaaacctaccgccacaaaacaaaaatcacattatacaaagcccgtcttcaaacgactcggggaaagttatttttaaacaaaaaaccactcatgacgagtggtttttcctttagataataaagtgatcgactttttcaatcagctgatgaatttctggtttactaatttgatcatctgcaccgattgtttcccctttatggcgcaaatcttcagtaattaacgaagagaagatgagaatcggtatggaactcgttaaaggattttccttcaacagtttcgttaatcggtgaccatccattttaggcatttcaatatccgtaataatcatatcaatttcttctgtcacagtaattcctttgctgacaaggtccatgacatggtcatatgcctgtttcccgtcttcaaaggtcacaatgtttttatagcctgcttcggttaattcatttgttaataaacgcatgagaagcggagagtcttcaacgacataaagcttcttccctgttcttctctcgtctttctcaccgtcaaacatatgatacgtttctacgccagaagcggattcaatatcataaatgattttctcgtaatctggaaggaaaatcattttctcatcaagcttaatgataccggttaaatgacggtccatcccttgattgagtgcagttggcttttcaatctcttcccagctgacgcggtgaatttgtgataccgttcctgtatggaacacaaatttccgttggttgaattcagtcacaatatatttctcttgttctgactgatctgactcgacattaaaaaaggaaaatagattgatgactggtaaaatctcgcctcgtaaactaatcatcccttctacatcttggtgagagtgcggtactaccgtcacctcaaccggctgaatgatttctcttactttcatgacgttaatgccgaattgatttgaaccaatttcaaacttcacaatttccaattcattggtaccagagtcaagtaaaatttcttgtttgtttaaagccacggaaatccctctattcttcaatataagattgtactttttatatcggcagcataggtaaaaagttgacgtttctttacgctttctctcgtacgaattgatgaatcacgagtcctatcgctgcaagaatgagtaaagaccctagtgcaaggcggcttgcgagatttccgtgctcagcaaacagcagagtgactgacccataaatgatgggtccaataatggacgacaccttccctgagaatgcgaagagaccaaaaaactgtcctctcttttccttcggtgtcagctcgataatcaatattcgtgatgctccccagcttgcaccgagtgaaattccaaataaactgccagccacccagaagacccattctgttgcggctgtcacagccaaaatcagagcaacgatcaaaatcacatacacgactgtaattgagcgctttgccccaatcgcttttgtgatatatccaaataaaaaggagccaatgatacttgaaatagtcgacacaagataaaggagtataaattgcccagcggtaaagccaatgatgattttggcatacacagccatcatcgcaatcgctgtctgcagggcatcattcataaaaaagaaagcgatcataaagataaaagccggcttgtaatgcttcatctctttaaacgtgcgaataatttctttatacccgctgaaaaatgacgcctttttctcttgttgcggcagtggatgagggtcttttacaaaaaagagaaatggcaggaaaaagagaaagaataaaagtgctgtcggaataaatgcttcatgaaattggtcattgccaacaagtaaataaactgagagaccgacgagtgtccctaaataaccaacggcaatgccaaatccagaaataagcggtatttcatcctttgtcccaagatcgggcaggatggtgtcataaaacactaggctcgagtgatagaagaattttgcgatcacaaataaggtgacaacgactaataaagagacaggcagcccaaaccattcgcttgagatatcaattccagcaaagatccccatcaaaaacgtacaaactatacatatgagagtaaacactgtgatgtagcgcttcttttttcctgtacgatcgatcaggactccgtataatggtgtgaaaatgacgagaaaaaaactggctagtgcatttgcataagatataaatgtactagcgatctgatccattcttgcactgtctccgatcgtttcctgcaagtagaacgggaagaaaatggtgatcatattcgatgaaaatatcgtatttgcaaagtcatacaatgcccaggccaaaatgggtgctgtcaaaaacagcccgaagcctgccccttttttctgcatggtctttttccctgttttcaatcgtttgtctcccttccctgcctaattttccactatgattctattttatgtcatacgtccctcttccatacaagcaatctatagaaaaagcacctcttacgattgagcagaggtgctttttttcattatttcttcacaacaatggtacttgcaattaaatcgtgaagtgcttgttttttctctgtgaagaaggcaatgatgtagccaatgtataggattggagacaaaaagccttttgcaaaaaagcggcctgttgcacggccgaatgtcactttttcacccgttactcttgttactttaatcccaagagccattttaccaagcgttccttgtagttttgatgattccatgatggcgtaatatagccatgtcaccacgataccaaccaagatcgctcctatgtagaaaaagataagtcccataatcactgcccagtcctcatctgtcataacagttgttgaatagtaatagctgtcgtcatccatcatcattgctgcctcaggacttgagacaaaaaagagtgttgccaaaataaacatgacaaaagaatatggtacgccgatgataataccatctaaaagatgtgcaagaaaacgatagcctacgcctgctagttcaggatgcttcttttctagaatgtgtggttctgttatgtttgtttccatcctatttctcctttattatgtatgttttctataaatttcttataatcattcgttattatatcttatgaatatcgcaagatcaatgtaactttacacttttacatatattttagatcaggtcgtcctcaatgatttatgcgaataaatactgaaaatttgtgaaaatcatggcacttctagttcttttacctcctaattttttaacattttgtgatattttcgtcttgtttccattctgctgttgacaatcattcttcacatggtacaatagtcaaggattttttaaagaaaggtgttcatgatgggaactgtcgtactattaaagaacaatgaaatgactgtgattgaagatatttgcgaggccgattttttagacatgaagcatgatttgtcaaatgatgacgcagcttatatctcttggtatgaagattacgatactgcttatggatattgatttcatttcatagatgaagcgtaaaaaaaggcgatacaacctaagttggttgatcgccttttttacatttgcgtgcttctttcactttcaggttctacatgaataaagatttgtgcatgcggaaattcttgctgaatcttctcttcaattcgatcacataattgatgaacatcttcaatcgttgtcttgccatttacaatcaaatggaaatcaatatattcctctgcaccggatcgtcttgttcgaaagtcatgatattcgatgaactcctgactgaacccttgaatgattgcttcgatcgattgttcttcctcgggcgttagccgggcatctacaagcggcgggaaagcctctttcatgagtttaaatgcttcgcgcataataaaaagagcaagtatcattccaatgatcggatctaggaaataccagtcagttaatgcgacaagcaataaactgactgccacccctaatgacgtatacacatctgttaacagatgcaatgcattcgatttcatggcgacagaatggaccctttccgcctctttgttcacaaccttcgatacgataaaattgatgatcgcgcctattagcatgaccacaatgccaagtacaggcagcttgactggctctggatgcattaatttgtgaacacattcgtagatgatccaaatgcctgcaacaaaaatcaacagagtttcaatcgttccagaaatattttcgacttttccatgtccataaggatgtttcgaatctgctggctttcttgaaatacgaacagagataaatgcaataaatgatgccattaaatcgagaaaagaatgaatagcttctgataacaccgcaacagatccagtgagcagacctacaatgatttttaagatgacaacaaatgtgttgctcatcacggatagaaacgctattttcgatgtcttcgctgattgttccatttatcgtcctcctttaggagatcgtatgtctatgaaagcacttcccatgacttgattctctcgttctttcagtttacacagttttgctgctttctaatcatgttcatcgcagcctgtattttctcgtgaggttacgctataataaatgttgctctttcttcaatatatcactcatgctgtgatgaataggagaatagactacagataatgatatccagtgcctttcgcaggtgacatttatgcagtgaatggtaaaataggataaaaacataaatttttaaggtgatgagaaatggagcatttgctgaatccaagagtaaaggatattgaaatttcaggcattcgaacattttcaaatctcgtatcgtcatatgaggatgtcgtttctttgacgataggccagcccgatttttatacgccgcatcatgtcaagacagctgccaaagcagccattgatgagaatttcacctcgtacacacataatgctggttttctagagctaagacaagcgatccagcattatatcaagaagaaagtcaatcttgattatgaagctgagtcagagatcattgtgacgacaggtgcaagtcaagcgattgatgctgcgtttcgaaccattttgtcagagggtgacgaagtgattttacctggacctgtctaccctggctatgaaccgatcattcgaatgtgtggcggaaagcccgtacatatcgacacaacgaatgctggctttaaattaaatgccaagctgattgaggatgcattaacggaaaagacaaagtgtgttgtgcttccgtatccttcaaacccaactggtgtcacgctttcagaagaagaattgaaagagattgcccagctccttgaaggaaaagacatctttattttatccgatgaaatctatagcgagctgacatttgaccggccgcatcattcaatcgcttctttcttaaaggaacagaccattgtgattaacggactgtctaagtctcatagcatgactggttggagaattggctttttatttgcttcagctccaattgctaaacatgtattaaaagtacatcaatataacgtgtcttgtgcctcggctgtctcacaaaaggcggcacttgaagctgtaacaaatggtgtggatgatgcactcatcatgagagagcaatataagaaaaggctcgattatgtatacgatcggctcatttctatggggcttccggtcattaagccttctggcgctttttatatttttccatccattgaatcgtttgggatgagttcctttgatttttgtatggagctgttagaaagcacaagacttgctgtcgtaccagggtctgctttctctccactcggcgaggggtatgtgcgtctgtcctatgcttattcacttgaaacactgaaagaaggacttgaccgcctagaacaattcgttcttgaaaaacgttccattcatttaacagactgaaacaacggctctcctgccgttgtttttattttgcaggaaacatgatgtgaaatacggtgcccttttcgggatgactatctacacggatcgtcccgttgtgattttctaaaatattaaatgtgaccataaggccaagtccagtccctttttcctttgtcgttaaaaagggctctcctattcgcttcatgaccgattcaggaataccgaccccttcatcacgaatggtgacatggattccatctctttctgctttggccgtaatgtcaaccttccctccatccggcatggattctacggcatttttgattaaattgataaacacctgcttgagctgattttgatccccgttcatcaggaggccctcttctatctcacttgtgttcattaaaatgccatttaagttcgcttgtgtttctaataaagccgtgacttcgctgatgatttttttcaaatctagtgtctgcatcgatgccgtttgctgcggttttgccagcatgagcagctcgcttaaaataatttctatccggctcagctcagagaaaacaatctcgaaatattgatcccgatcttttgttttcggtttaatgagctgcaaaaagcctttgatggcagtcaatgggttcctgatttcatgtgcaatgccagcagctaattgacctgcgatcgataatttttcagatcggagcatgagctcttctgtctgcttacgttcggatatatctcttaaaataatttgaacggctgtttctccaaaaaatgtagttgggatacacaccatttctgtatagatcagcttgtgcttaaatgtatgacagctcatcgtgacaatttcagaatctgatgctctttcaataatacgtgatatgctctttttcacttttggctggtcacaggaatggatttgatgggaaatatcttttcctattaatttatcgtaatgctcggcttcaaataatttaatgcctgattcattcataaacacccatttgtgatcgtgaatgaccgcaatcgtatcaatggagttttggatgagcagctgatacctctcccggcttttttgcagaacggtttggaatttcttacgggatgagatgtctactaacagcaaaagctctgcccgctgattttgatagatcgttggtgatgacttcacttcgatatgaatgctgctcccatctttccgcttccatatctgttcaatcattccgactggaagaccttgctgcagcctcgtaattcggcttctcacaatgtcatggtactcctcagcaataaagtcaaatgcagttttgccgatcatatcatctcttgtacttacccccattaattgaagcatcgcatcattcgcataaacaatttcccctaaaatcgtaatacataacggatttggcagcatggcaatcaattgttcagcttcactgacatgttggaaagccggcagactgcctaacgactgttctgacacttctgatgttgtttgaaatgctgctttttgcggttcagcgtccagcaccctcattttcaggatcatttctctacttaattcactgtctaactcatcacaatcaacaaaatcaatactagcttcaatccatacagctgttaggtcacttctcagcagcctaaagtggcaaatctccagcatgtgctgattgtagaaataactctcgacgagaaattgatcttcggtatgaacaaagtctttcaaaaaacaccctagtaaatccttttgttcatagagcaaaagctgcttacagttagaagaaatgtagagaaagcggccattagaagaaagaacggcatgtaaatcgatattcgaataaagctgattcgaatctttcattttttgttccatcgtcgtccgaccctccttttcattttttagggttgtccttagattgatgtataaaaaagattcgctagaaaacccgtattttccttccgtcatcgagggaaacgtccatattttcagcaaaaaagagcacattctcttgctgtgctctctgctgtttactgcttttcgtatttcttttgtaattcaacgtacttatcaacaattttacttggaatggttttaatgacaggatctttatctgagacgtaaggcgtcacgacactaaaagccacttttggattggacgatggatagtatcctccaaaggttaaattgtatgttggattgccccaccagctgcggttggcaccatagtaaaaggtttgggcagtccctgtttttcctgagacatcatgctgaccaaagcggcctgcggcagtaccgccggtcgatgtgaccattttcagtcccattttgacacggtcaatatctgctttcgagttgttaatcgtgttcaataccttcggctcatattttttcacgactggacctacctcatccttcttcgttggaagatgaacgcttttcaccactctcggctgaacgcgatttccaccattagcgatcgttgacatatactgggcaacttgaagcggtgtatacgtgtcatactggccaattgcttcatcgagcaaaagtccgccgaccgtcttcggatgtgtctgcatcccgcttgattcctgcggcaaatcgatccctgttttcacgccaagaccgaattgcgcatagtagtttctcattttttgcaggtgttcaggtcttgctggtaacggaccatccttttgataagtgatgcctgccattctcatcgctacttggaacatgtagacgttggaacttttttggagagcctgaaggtcattgacccatccaagaactttatatgactgtttcggctttccaccacttcctgcaaaaaagagcggtgtatccatataggattggttgtgcgacattccgtcctgataaccgccaagtactgtggctcctttgactacagagcccatttcgtactgggtcgtaaatgttccgatggcataatcagtgacgtctctgccgtccattttcttgccagacatcgcaagaacatccccagtgttcgggtccatcatcacgacaaatgcgcggtccatcatatagtttctcgcactagcggatctaagctctgattcgacgatcttgtcgacttccttttgcagctccatatcaaatgtcagtgcaaggtcaagtcctcttcgtccctctgtccgcttgatttcatcgagcagcttcccgccaacctgagtatattgaacggtcgctttctccgggttcagaaaatcctcgtattgatactctaaatagctcttccctactcggtcattacgtgagtagcctcttgccatatagtattcttcacgctcttttataatcccctgctctggtgtagtcacaccgccaagtacattataaagggtcttctcatacggatattttcttgtccaatcattgatgacattcacgccaggcagttcatcaagatgttctgacacaagtgaaatctcttcataggtcaaactcacagatgatgtctgctttgactcttttgtttcatcgagtaaagcaactttttcgtccccttttttctcttcatttgggtccattgctttcacgatttgaggctcaaaggcatatccgcctgtaaatctacgatagatcgctgcaactgctttttcctctgcatttttttcgatcgccttgacctcttccttaggcacacgctctacttgaagcggatagacatcttttgctttaagtttcttttgctctgcttttgaaatgagcttatccgcttctttcggatggcttgccagccaaaaatctcgaatgtcacgctctctcaaaaaatcagtatccatttttatataagtcgcaagttttcttgctactttaatcttatccttcgccttcacaccgctttctgatgtataaacgatggcaggtacactttcgttatcaacgacgactcttcctctcgcgtcatacatttttcctcttggggacgggtatgatgctgttttgacctctgttcggtttgcttgctttttataatcctcaccattgacgatctgcagcacaccaagcttgatcacaagtacagcaaataaactaaagacagcgaagaaaaagagattaatcctccaggcgttccggcgcttgaattttttctgctcggcaccaccttgatgctgtttctctcccacttatgtagctcctctcatcctttcaatcttttacaattaccactcattattgtaacacttttgtaatagttgttacagcgaaacaagtgaaaaaaagctgtcaatccctattatgaaaaaaaatatactaacactttaaaatattggtatgtttatgtcgttttcattaaatggaagaatcccctatcctttgatatgaggcggatttttttatgactttaacaaaaatgacaaaaaggccttgtcaatggaggatgctggtacgtttataacaaaaagtccatgttatgattttctgtgagaaaacaaaacaaagattttaggaggagttacaatatgaagaagaaatcattctttttttcagcgctaacggctgctgcactcatcacgttcactgggggacattcagctgatgcgaaggagcttaacctgaaacaagtgatacaagtacagcatcaaactattgatcttcatacattagctgcaaaattacatatctcttcagatgtaaacaagctaagcaagtcgaatcaaaaagagatcgaagctcttttaaacaagctaatcaaaagcggtcaacctgttactggcacaaaagtggtgaaagaagtaaacaaagcaaaaaatgaacaaaaacaagaatcagtgaaaaaacctactgcttctaaaccaagtacgccagcaaaacaaaacacaaacaacaataacaatacaaaagctgaccaaaaagacacaacagcagcaaaagcagacagcagcttgaatgcatttgaaaaagaagtcgttgagcttacaaacaaagagcgtgcaaagcaaggattaaaagcactttctgttgattcaaagctaagcaaatctgctcgcgcaaaatctcaagatatgaaagataaaaactacttctctcatacaagcccgacttacggatctccatttgatcaaatgaagcaattcgggatcacttacaaatcagcaggtgaaaacattgcccaaggtcaaagatctcctcaagaagtggtgactgcttggatgaacagtgaaggtcacagagccaatatcttaaacaaaaactatacacatatcggtgttggttatgtgaaatctggcaactactggacgcagcaattcattggaaaataagatcaaaaaacctgtcccctatatgggacaggcttttttatttcacccataatttatatatactctgtgtgccgctgttttcttctccctgctcactcagcttttcatatagtgactttgcaagtgagagtcctggcatttcttctcccatcagctctgcttcttcaagtgctatgcccatatctttaataaaatgcttcacgtagaaccctggctcgaaatcacctttcagcattcttggtgcaaggtttgacaaggaccagcttcctgccgcgcctgttgttatacttttgagcacgtgctctggatcaagtcctgatttttcggcataggccatagcctctgcgacacctaccatccctgctgcaatcgcaatttggttacacattttggtatgctgaccgctccctgcaggtccttgatattgaatgttttcgcccattttctcaaataaaggaagacacgcttcataggctgatttttctccgccaatcatgatcgcaagcgttccattttttgcacctacatctccaccagaaactggtgcgtctaatgcaaacagccctttttctttcgctttctcttcaatttcttttgccagctgaggcttcgatgtagtcatatcaattagataagtaccaggcgtagcatatgccacaagcccctcttcccctaaatagatttcttctacatctgatggatatcctaccattgtgatgacagcatctgcatgttctgcaatttccttcactgccggcttccatgatgcgcctttttgaatgagtgcatctgcttttgcttttgttcttgtataaacgagaacttcataacctgcatccattaaatgttctgccatactgcgtcccattacaccaattccaataaaaccaactgttttgattgtcatcacttattcctcctcaaagagactttgtcaatccaccatcaatgataagtgtttgacctgtcatgtatgtacttgcttcagataaaagaaaagctgcatatgctgcaaattcctctggctgtccataacggccaagcggaatcgcatgttcagcctgtgctttgatttcttcaaccgtttggtgctctgactgcgcgcggtgcttgtccagctgtttgactcggtctgtttcaatttttcctggggctaacgtattaatcaaaatcccatccttggcaagctcttgagcggctgtttttgtccagcccacaatagccggtctaaaagtatttgacagcatcaagcctgggatcggttcttttactgacatagacgcaatgtttaacacgcgtgcaccgcgttttttcaaataaggcaaggcctcttttaataatcgaatatagctgagtaaatgaagctgaaatgattccatccagtcttcatctgttaaggtttcaagcgtccctgttttaggcccgcctgtattgttcacaagaatgtctagatacttctcatcaccagctgccgcttgaactagcgccttgatttgctgcgcgtcagacacatcacatacttgatacgtcagctttccttttacaagcggagataattctttcaccgtttctttcagcgtgtgctcatgccttcctgaaagcatgacatctgctccctcttttgctagagcaaaggcaatggcttttccaataccttgactgcttgcagcgaccaaggctttttttccagataaattgacattcatgtcaacacctcctctgctttattttatcatacaaaaagaaccttgctcacgccgcaaggttcctttctgcttgattacaccttaaatctgtcaaccgcctgacgtaacgcctggcttgattcgttcagcatttcagtcgaagttttcgttctttctaacgcttgaacttgttcatctgtagacgcatgtacttcctcagctgaagccgcagattcttcagaaattgcagcaatgctttgaatggagtcactcatcttctgctgttcttctgtcatttcattgatctgtgtatgaatgctgtcgattgatccgacaagtgcctgcatttccattgtgatgctgctcagtgcctcgcctgttgcattaatggcgtcaccttgttcttcattcatcttacttgctactgtcatcgcttcagccgccttcttcgattcatcttgaatgagtttaacggtttcactaatgtgttttgttgattccgcagattgttcagcaagttttctgacttcttctgcaacaacagcaaagcctcttccgctttctccagctctcgctgcttcaatgcttgcattcagtgcaagtaaattcgtttgatccgagatttgagaaatggctgtcactacattttcaatattttttgttttatgctccaggtctagcagcatttgctctacctttttcgattcttcgctcgcttttgttgatttttggacgagcaccccaagtgcatctagccctttataacttgcgtcttctgatgattttgagttggtttgcatttgtgaggcaagctcacccatatggcgcactttctcatacaaatgctctgatttctcattaatcgtttctgcatctgaagcctgcttagtcgcccctgttgccacctcttgaatggccgttgcaatctgctcgctcgacagcagggtttcatttgaaatttgggtcacttcatccgttgatgtcacaacttgatctgaagcccctttcactttttcaattaactccctaatgtcctctatcatttgattaaagcttttcgtgaggagaccaatttcatctttggacttcacttcaagcgtacttgttaaatcgccttctgacaccttacgcacatgccctgttagacgcttgattggcgttgtaatgcttcttgccaataataagctgaggatcatcgcaagaataatggcaatgacggatattatgatacttgtctgattcatttgttctgtgatccatagcagtttctttttctcaaagctcacgccaaccgtccaatcggcttctttgattttagatatgaccgtcagttctttgctgtcatcaatacctgagttgtcaagcgcttttttcacagaggagacctttgatatgttttttccttgctgtgttggatgcgccaaaatggtgcctgtgttatcaactaagaaagcggtccctttataagggatctcttgttcatttatataagattgaatggaggagagcttcaaatcaagtccagcgactccaatgacctttccatttttgacaatcgccttcgtggctgaaacaatcacttttttcgttgcttcatcaatatatggatctgtccaaacaacctgatcaggcttttcggctgcttgtttaaaccagccttgtttagatggatcataccctttgccaagatcgaactccgggaagccgagcattttgccatcagttgttccaatataagcaaacgaaatgagtttatcctgttcctgcaggttttttattgcacttttttcaaaatccagtgtttgttttgtttgtttttgcgcaaattcttcagttattttacctgttgccaatttgttaatggtattgccgtaattatcaagcttttctgtaataatgtctttcaggctttctgccgttgctgtggcggtcgtttttgcatctcgttcaatcagtggtgttaataccaagttggaacccacttgaactgccacaacggttaaaattaaaataactgagatgaaaacagctattctcacttgaagtttcttaaacatctcctcacacccctatatcctactttcataccttgttgtatatatcggcattattgataccgcattcaatagttgtgagaaaatttaaatagaaaaaacaagccataaaggcttgctttaagtaaaatattcaatttttgcattcggaaagtactgatcgatatatgattctaacgtctgtcttagttcttgttcctcatctttttgatagatatatttcccaattccatatctaccccacttgtaacgtcttttttcttcatctaattctaattttgatttcggatagtttttttggatcacacgcttcgctggttttgtaaaacgatgctggatcatttcaaaggtgatatcgtgcctcacatcttcaggtagagctgcatcgagcttttcaaaaagaactttatatccttcctgccagccttcgtgaatgtagattggggcaataataaagccaaggggataacctgctttcgcaaccttgacagccgcttcaatccgctgatctaacggtgatgtaccgggttcgaaatatttaatgacataatccgcattgatactaaagcgaaatcttgtccggccattatgctttgcatcaagtaaatgatcgacatgatgaaatttggtcacaaagcgaagcttgccaagatcagtctggccgaagtattcaattgctgtctttagtgtatgtgtcagatggtcaattcctacaatatctgacgtacaagaagcttcaaatctcgtgatttctggcgcacgttcgttcatgtactgctccgcctgatctaatatttcttcaacattcacatatgttcgaatgtatggcttacttcccatcgtcgtttgcagatagcaataatggcaatgccccatacagcctgtcgcaaatgggatcgcatactctgcagatggtttagacgtatcgaacttcaacgttttcctcacaccaatgacaagcgttgatttcgcattacgatacttttgcaagtcattcttacccggaatatttcttacttggttatgtgaagtcgtttcccttatttcaatccccatgccctcgaacttttccttcagttctcgtcctaacgggtactctaacgcccgtggttcaatgtacacaagctggggcacaaaaggtttgatcatatttagcacatccttaccctataggttttcataccgttactttaaccgtgcaggatggcttttatcctttctaaaatctcccttattcaaacaaatcttgataaagagcttctgcttcttcatatgtcgaaaagaccgcatcatctggagctaaaggatggtacgtttcaagtaaaaatagggcaagctcctcttcgttgtatggatgtgaaacaatttctgcttctttgatttgtgctacgtttgctgcatgtggatttcgataaatcacatagacttgatcacccggttgatagtctgagaaaggcaatctggtcacctccatttttcttatagaatgcccttctctctgacggatatgacccaatatgataaaattcgacaaaaaaaccagacaggatgactgtctggtttgaattcacttagttatgttgaaacgttttcttcacgaaatcaaccacttcttctgtagtgctaagtgataaaatatgctctttaaatgatgcagcttcttccttagaaagcttgcttagctgagttcttgctggaagaatagatgttgcactcattgagaattcatctaatcctaatccaagtagaagaggaatggcgatttcatctcctgccatctcaccgcacatgccaacccatttaccttctttatgcgctgcttcaataacaagcgtaatcagacgtaaaatcgctggattgtaaggctggtaaagataagacactcgttcgttcattcgatcagcagccattgtgtattgaatcaagtcattcgttccaatactgaagaaatcaacctcttttgcaaattggtctgcgatgacagctgttgatggaatttctaccattataccgatttcaatggaatcggatacgtctgtaccagcggcaaccaatgcttctttttcttcaagtaaaatggcttttgcttctctaaattctgataacgtcgcgatcatagggaacatgattttcaagtttccatatgtacttgcacgaagtaaggcgcgtagttgtgttctgaaaatctcctgttcttcgaggcaaaggcggatcgctctaaagccaagaaacgggttcatttcttttggaagctgcaagtaaggaagttctttatcgccaccaatatctagtgtgcggacaaccactgctttgccttccattctctctaaaacagttttatatgcatcgaactgctcttcttctgtaggaagctgatctctgcccatgtataaaaattcagtacggtacaatccgactgcttcgccgccattttcaagtacaccttttacatcttcaggtgttccgatatttgcagctagctctacgtgaacgccgtcttttgtgaccgttggctgatcaacaagtttcgcccattccgctttttgagctaagtagtcttcatgctttttttgatacgctttcacttcatcttcagaaggctgaatgatgacgtctccgctaataccatcaacaatgatcagatcattgtttttcaccgtttttgttgcttcttttgttccaacaacagctggaatctccattgatcttgccataattgctgagtgagaagtacgaccgccgatatctgtcgcaaaacctttgacaaattgtctgttcagctgagctgtatcagaaggagtcaaatcttcagcaatgatgatgacttcttcagaaatcatgcttggattcggaatgtcaacgcctagcaaatgtccagttacacgttttgttacgtcgcgaatatccgctgcacgttccttcatgtattcattgtccattgcttcgaacattgtgacaaacattgtcgctgtttcttttaaagcaaattcagcatttactttatcagagttgattttatcctttactgggtttagcagctctggatcacttaacacaagaaggtgtgcagaaaagatatctgctttgtcttggccaagctcttttagcgcatgttctttaattgcttcaagttcttgtttagaaacatgaattgcttcttcaaaacgcttcacttctgtctctggatcgttgatgtctttttggtgaactgttaaatctggttcttccagacgatatgcttttgcaatcgcaacgcctgctgaagcaccgattcctttcagttgttgcattactcgcctaggccttcacttttcattgtgtctttaagtgcagcaagtgcatcattttcatcagaaccagaagcagagatagtgattgtagcacctttcgcaattcctagagacattacacccataatagatttcaggttcactgttttaccattatattctaagttgatatcagcatcatatttactagcagtttgtacaagaactgttgcaggacgtgcgtgaattccagaatctgcagttactttgaatgtttgttgagccatttttatcaatctcctttttatacaattaatacatccacaatattatatcatactgccgagcttgtcatctaacaagaacggcagttatgaaaattattttgaaattttcatgatgttttcttgaccagcgttgatttcaccggatttttgaaggtcaataaattgtccttcacttaagttggtaaatacaattggtgtcattaaagatggtacttcagacttaattttatcaatatcaacctctaagagtttttgaccgatttctacttgatctccctcttgtacaaatgcttcaaatccttctcctttgaggctgaccgtatcaataccgaagtggattaaaatttcaagtccaccatcagattgcaggccaattgcgtgtttcgttgggaatacatttaagatcttccctttcaccggtgaaaccaccgttccatctgttggcaagatggcgaaaccgtcacccatcattttccctgagaatacttgatctggtacatctgtaatcggatgaagctcccctgtaattggtgaagcaaagatttcttcaccttgctcgttttgaagcggttttgcaatgacttcttcgacctgctggctgacttcttcttttgcagaagggtctttcgctggacgaggcgtgcggcctgcaatgatgtcctgcatttgtgtttttaaattatcagagcgtggtccgaagatagcctgaatgttgtttcctacttcaagaactcctgaagcaccaagctttttcaagcggtctttgtccactttcttctgatcattcacagtaacacgtaaacgcgtaatacaagcatcaaggtgtttaatgttttcttggtcacccattgcttcaagaatttcataaggcaagtcattacccttttcagacttagcactacttgcaccgtcagctgcttcatcctcacggcctggcgttttcagattaaatttgcgaatagcgaatctaaatccgaagtaataaataacggcaagtacaagaccaactggaatcacaagccaccaagcagttctgtttggcaagattccgaataagaagaagtcgattaatcctcctgagaaggtcataccgattttcacgtttagaatatccattatcataaaggataatccagcaaatacacagtggattgcaaataacactggtgcaacaaataagaatgagaattcaagcggttcagtaatccctgttaggaaagaagtcagggctgctgatcccataattccagcgacaagctttttattctttggttttgcttcatggtaaatcgcaagtgctgctgctgggagtccaaacatcatgaacggatatttccctgtcatgaatgtaccagctgtcagttgaacaccatctttgatttgtgccatgaagatacgctgatcaccacggacaagctcacctgataagctcttataactaaagaactcataccagaatggcgagtagaaaatgtggtgcagaccaaacggaattaatgagcgttcaatgacaccgaatacaaaggcagcaagcggctcattcgctgcgagcagtcccgttgagaacgagttcagtgcaccttggattggcggccaaatgactagcatcaaaagccctaaaataagtgctgaaatagatgtaacaattggaacaaagcgttttccagcaaagaagccgagatattgcggaagctcaattttataaaatttattatacatataagctgctaataccccgacaataatcccgccaaagacgccggtagacaaggtcggaatgccaagcatattaatatacgctggatggctttctttaaagaacttagccaatttgatggaatcagatggaattgatccattggccattaatacggcactcattgtcacgttcatgacaagataaccgataattgcggcaatccctgccacaccgtctccattagctagaccgatggcaacccctacagcaaataagagcggaagattcgagaagacaatgttccctgcattttccatgacgcttgcaacaagctgaattgtatcattgcttaaaaattgagctacatcaatcagctgcggattttgcatcgcattcccaagtgctagtaaaataccagcagcagggaggatcgcaactggaagcataagtgctcgtccaattttttgcaacacaccaaaaagtgatttaaacactagttgaacctccttttattttcgcttacaacgcacatgcgggacgctccctgacatccatttcatagttaaccgtttacatttcactttcaaacacaaaaaaaggcatggtgatataaggttgcgcaaataacaggatcttatcctgtatttaccttaagtcactcatgcctgatcgaatcagttacacgtttctaggaaactatgaaattttatttgtcaatctgtacagatgaagtgtcaggtagacagcctctgcatcctgtacaggctttttcaatgcatgttgtaatattttgatcattttccaagcagtattgtagcataaaggatattcatttttcaatagatgaagcaatttttctggctcctctaaagattcttcccgtttaatacgctcaatcgaaaacgtaatatggcgcaataagcgtaaataatgaatactttctctgtcgactttcatatgaaatgaatcttctatgacttggaccatttgcgtgatgagctgcgaatgacggttcacctcagataatggccgattcgttaaagctgagtgaatatggagcgcaataaaaccaatctctccttctggcaactttgtttcgacatcaggacgctcgttaatgagctcaacgacttcctttgcgacctcgtattctttcggatacagcgattttgtctcaagcataaagggattggtgatatcatatccttgctgcacccgcttaaaactaaacgcaatatggtcagtcagggcaatatgaatatgctcattcaaacggtgtcccattttttctcgtatatgataaatgacgtcattggcaagctcgatcatgttctcatcaatttggtgaagcaactgtttatattctgtttgttcctttgtatttttaagaacaaacattttttcaaatgtatcttgatcgagaacatcacccgattttttcccgaagccaattcctttcccaatcagaactacttcgcccaaagaagggtgtcttgcgatgatgacattattatttaacgctttatcaacggtgaaggattccatgaacatccccacctccttcttattcaatccctcttatcgtacaaaacagatgaaacgtgcgtcaacgattgtttatgaaaacggtggttgatcgctcgatcaggcgaaatggcagcattcttttctctggcacctctccttttatagctcggtcgaacaagtcaaacgcttcctgccccattcgtttcagcggaatatcaatgctggaaatccccaaggcctcacttaattgatcattttgaaagccgagtatggctggagattctcctacttttatatcgtgacgctgcgcctctaataaaaagcctgctgatacgtcatcatttgtgatgaataatgctgtggggcgattcttcatttcttgccactctgtaaataattgttttccatcaaaaagtgttagcttcccttcgatgacccattcttcatcaatctcctgcccgagcgctttcatcatatcttgataagcttgaaggcgtgactggctgtttgcgccttctattctggctagaacaattgcgattcgctgatgcccgcatgctgctaaatgatgcagcccttctttaaacgcttgatcatgagcaatcgacaccgttgaacagtcttcaattggcgccggatggcaaaaaatgataggcccggattcctgccaacttaaaatgtctcgatcacttaacgcatttgagcaaaagattaatccatccacgcggcgctcttttaaactcatcaaggcttctttttcttttaaagggtcatatcctgtttgaaataaagcaaaatgcatgccgcgcgcctgtgctttttctgcaatccctgtgacaagtctgctgaaataagaatgatcaattgttggaagaacgatgccaagcatatttgaataacccttggctaaatggacagcctgaatgtttctcgtatatttgagctctttcatcgcaccaagaactcgttctcgtttatcttctttgacataaggatgatgattcaacacacgtgatacagttgtcacagatacgcccgctctttttgcaatctcccttatgtttgccaatttttctcctactttctcttgatatggtaagcgtttcatactttaagatgtatgtgagctgaacaaatcactgggtggaaaggggaattcaagatgggtttcatcatatggattatattatgtatgactgttttgttttctgctcgttttgcactacatcctttaggaaaagaacataaaatcaaaccgtttcaatcaattgatgatttttttgttgataaggatcgaaaagagtgacaaaaaatcacgatgacacttccaggacatgggcgttcatcgtgatttttttattacttgatgatcgtcagctctttcggataattggttaaagtaactggaccatccgctgtgatcagtacatcatcttcaattctgacgccgccaactcctggaacatagattcccggttcgatcgtatacaccatgccctcttggagaagatcatcatttgcctggctcatcgaaggaaactcatgaacagacacccctagaccatgtccaaggcggtgagggaaatactctccatatccagcatctgcgattagcccgcgtgcttttaagtccaggtccccaattctcacgcccggtttactcatttcaagtgccgccatttctgcgtttaggacggtttgatagatgtccttttgctgatcagaagcttcctgataaataaatgttcttgtaatgtctgagcaatatccatcaacaatgacaccaaggtcaaataacacaaagtcgcctttttttaagactgcctgtcctggatttccgtgaggctctcctgatttttcgccaaagagaaccatcgtcgaaaaggacatgccttgaatgccttttttctttagctcatattcaatgacagcgagcacttctgtttcggtgactccttcttctaaggcgttcaccccaatttttaccccttcatctgccaattgagcggcttttttcagtgtagcaatttcagattcatctttaatgagtcttagctgattgagctcttcttctgcccgtacaaaagtttctgccccagtagcagcttgaagctgttctgctctttgaagcggaattgactctttttcaattgcaagccgagttgctcttacaccgcgtttttctactgctgactgaatgaaatcaaatggattctcatggtcttcataaccaataatatcgcctgaccacccagcatttttcgcctgctcgacttccattttaggcaaaataaaaaatggatctgcctcttgaaacacaaacagccccattactctttcatgcggctctgtgaagtatccagatagataaaacacattttcctttgtatgtataaatgcaccttgaatgtctttttcctttagccaagaagacaagcttttcattcggttcatcgtgatcctcctcacacgttttactactgatctattgtatcagtttttgttatatttcgcacaaaaacgcactggcagaagccaagtgcgctatgatgatttgcttaagatgcacgaagcagacgcagtccatttaaaatgaccaaaatcgtacttccttcatgcccgattacgccaaaaggcaaatcaagcacttgtaagaaattcgcacaaattaacaagcaaatcaccgttaatgagaaaataatattttgcttaatgattcgattcatctttcttgaaagacggatcatctttgttaagttatttaaattgtttttcattaagatcaaatctgctgtttctaaggctacgtctgttcctccgcccatcgcaacccccacatctgctgtggcgagtgcaggtgcatcattgattccgtcacctaccatgatgattgagtttccttgtttttttagttgattgacctcatggaccttttcatctggcagacactcagcgacaaccgtttggatgccagcttcctgtgcaatggcttcagccgttttttgctgatctcctgtcagcatgaccgtttggatgcctaaatcattcagctcttgaatcattttcttcgcttcaggtctcatttgatctttaaggccaaggcacccaacgactacttgatccttttgaacatacaccactgtatatcctttttcagaaagatactctcctgtctcttcaatctcacggtccattgaagccttgccagcaaagtctttcttcccaatccgccacgtttctccattcaattgtgcctttacaccaaaaccagaggtttcttcaatggtgacatgagctgatctttctatttgttgctcttgtgccatatcagagatcgctttcgctaatggatggtttgattgactttcaatttgataaagcgcctgataaaaggccgcttcctcttgtcctttagcgatcaccacctgctctacagctggctttccgcttgtaattgtccccgttttgtcaaaagcaatcatactgctagtgcctagcttttctaaaaagacgctccctttgacaagcattccgtttcttgcgccgtttgagatcagtgacaaagcagctggcataatggatgcaacaagcgcacaaggtgatgctacaaccataaacaccatagcccggtagaaggtttcactcatactccagcctagtacaaaatgaggcagaaccattaaaatcgcgacggtgatcagtacaccttttacataagcaccttcgaatttttcaataaatgcctggcttggcgacacactttcttgagccgattcgacaagtttaataattttatggaaaagcgtttcttcattatgtttggtcacttctactgttaaggaaccatttaagttcactgtgcctgcaaacacgtcttcaccttgccctttttcctgaggcacagactcgcccgtgagcgcagattcatctacacttgttcttccgcttaaaatcacaccatctgctgcaatacgttccccagctttgatcatgatacggtcacctggtgttaatgatgaagcagcgacttgaatggtcgtgccatcttcttcaattaaagtcgcttcatttggcgcgatgctcattaaagctgttaaatccttcttgcttttatttgatgtatacgtttcaagcgcaccactaagcgagaaaataaaaattaagatcgcgccctctgcccaatatccaatgatcgctgagccaatggctgcgaaaatcattaaaagttcaacattcaagcttttagacgaaatggtttcttcaattccttccttcgcctttgcaaaacctccaatgacaaatgctaggatgaaaagaggaatgctccacatgctctgatcctttaaaatccatccaattaaaatgagaatccccgagatacctgctgctattaattctccgtgctgtgcccattgatgaagggaccatttcgattccttttgatttgttgtttgataaagtgctgtattctcattcatgattgttttctcctctctaattgataatggttttcacatcatcaattgttgcccgtttccttttttcatctatattttctgctatttcaagctttttataggtctgttattcattataacaggttctgactgattttcaattaataattattataatttctttttgataataattatcattattgatagggaccattccatgttctgagcacagtttattcagatgaaaagaaattgaacacaaaaaagaaccaaaggaatgacccttggttcttgaaataaggttttgttctaaaaattcgtccactctttgatttgttttttcgtcagtggacctacatgatttttcactatttctcctttttcatttatcaaaaagctggttggaatggtgatgatttggtatttcttcatcatgtgccctccctcatctagtatgactgggaatgtaaactttctgtctttcacaaattgggcaaccgcatgtttactttgttcagcacctagtaagttcaccgttaagatatcaacatcactctgattttctttcacgatctggtcaaatacaggcagctccattttgcaggacgggcaccatgttgtccaaaaatgcaaaatggtcttttttcctttcatcggaatcatctgcgtctcaccagttaatgtaggagcctctatctttggcgccataacgggctctttcgctccagcctcgctgcctatgagtaatagaagcatggtcatcataagaagactggcgggtagatatttaagattcatcaggatcttccttcccagttttcttatagcttgcccgctcgccgaagagggcattcatgcttttttcattctaagaaacatggaaacaccgagctccttacaaatcgtcgcataatgcagtgcagtcaagaggagcatgcccgtattcatccctaatataacccccatcatatttaagctttcaattgatccgagaaaatacaccattgaaaacgagacgacatgcacccatatattatgtaggaacacatctttaatgagccccataccgattaagcacgcttgaaacggcatcacaaacaggtggcataaaaagtacggccaaagcagctgtaagtagacagcagcttgcggtgaatcaaaaaagagctgtgtgagcggataagcaaaataatacatcaccatcactgccggtaccccgtacccaaatgtaatgagaatcgcctgcctgacacgttttttcacaagatcatactgacctaaagcataggcttcagatacattgggaatcatcacaatcatgatggaatgagcgataaacgctgggaaaaaaccaatcgacatcgcgacaccagccagcatgccgtaatgatcaacagcaagtgtgccagagatgcctgcagcaataagtgcccctttgattaaaaatggttctatggcatttgcgattgcatgaaaaatccgcatgcccgttgttggaatagagacggctaatagtcgctttctcacgtcaatccctcttaattcaacagacctgacatggacagcattttttgccatgacgtattgggagtataaataaataaagacgacaagatcactcgcaacaatgacaccgatggcaatgagtaccgctgtttcaatatcaaacgaataccaatgaaagaacaaaaacaagcaaataagctggatcgttttcttcagcatattggcaagagcgatcctgcccatttgctgctttcccataaaatagccgcgtgcaatcgaggtaaacgcaataattggaataagagacagcacaagccctttcatgagcggatgatacgactgaaacactggaatgaacggcagaacaatcgcagcgatccccgttgttgtactcgtcaccacaagcgtcattttaaacgcatggcggagcatacttttatggagccgctcatgcgattctgcaatgaatttagaaatggagactggcagctctaagctggcaattacaaggacaagcatgatgattggaaggatactcatatatagacccattccatgctccccaagctctctcgctaaaatcatattgactaaaaactctatacactccgcaatgaaagctgcgacagatagcagaatgaccccttttacaaatcgattcatgtagcctcccctttatctaaagcaaattcttttcacattctatgagacaagtcctgaaaatattttgataaatgaagacaaaaaaaagagcgatctgattgatcgctttagaacattgacaaagggctaaaaatgtttttattttagttctttgtcttcctttcagcgtgatagaaaaccattgcagtctaggaagggcgagcacaggagcgaattgattattcgtgagcaccggagcacagtcctgacaaagaatgcgagggtttgtctacacgctggagcgatctgattgatcgcttcaattctttatacggcaaatacgtgacgaccgatacgttctacaattttgcgagaacgaatccagttatctgttgccgttttgggattataaaaataaatggcctttgttgttctgtcatgttctttcgctacttgcttcacagctttaacagaatcttgatctgctttatcatgaatacttccatttgatactggctggaaagcatttcgctgataaataacacctttgacactgttaggaaaagagcgatgttccaccctgtttaagacgacgcttgccacagcttttttacctgcgtaagattctccttttgcttcagcatgcaccaatcgtgagagcagttccatttcttcattagaatagtgtttggcgctttcctcattcgttgtttctgattttactcttttcttttgcttcggttttgaagacttctcttctgtagacgtacttagcattttgactttcggctgacgcttttcctctgaaaatgctgggatgacttgatcgtgatcatctcgatctatatatgaaagctcatgcttaacaggtgcttgtgaaagttcgtgacttaatgtcccttgctgctcttgtatgttgtccatcttcatggctgcaatcagcataaggatgacaaaaagagcggtatgaattttcatcattcgcctcattcctcctttaattaaagtaggcggtaagatacttgtccactctaacaagacctccttctattttcacgcacaaagatttgcatgcctgtccaaattccgtcattaattggcatgtcctagttgatttgcgtatcaactggaattgttagcgcttaaaagggtcccttttccgcctataaacatccttatgatcctaattatgggttattacattttcttttcagatgtatcaagctcgtttgaagtgtgacaaaagaactaaaataaaaaagctttctctcattcatgagaaaaagctttagcttcttgcttctgtaagatattcaaaaataacatctccaccatgtttcgcaatcccgcgaaaatgcttaaaatcatcttgatttaccaagatcgaacgaaacgttaagaaatcatctttcttgatagttacttgcttttctgtcccatttcgtaacgattcaagtattgtgaggatttgttcttccgtcaaaaaaaccgctcctttacagccattatcaaatattaaatataccatccgttaggaaagcatacaacgaaaacaaaacaaaaacgtctttatcctttacattggtatgaaaatattgcaaaatactttttaatagggaatgaaatctgtttttaaaggagagggatcggttgaagattgcaaaaattggaaatgtgatcgaatttagaaatggtttaacaggtgtagttgaaaaagtgaatgaaaactctgtcattgtggatgtcaccattatggacaactatagagatttagaactggattcactaacagtcgttaatcataaaaactataaaatcatcaaagactccgtacattaatttgcaatcctcaattcagattatcgatacatacgtaaatacgaagcaaagctgctttctgacagtttagctctctttgacaatcacatatgaaaaagactgacaccatatgaagaagtgtcagtctttttgcgtatgaaaggtttgcatttctgctttcgttttgtacatgtccacttcctcgggggtgataacgcctttatcaatcaaaagtgcaatcactccaagcaatgtagaggcactccatttatatcgttctttgttttgatgttcaagcatttgaagttcttcttttagctcccttagcagcttctctgtcttttcttctttgtttaccaactcaaacgcctccattagtcgttcattgcctctattttatcttaaagcaaataagataagcaaaaaacacaattcccctttacaaacatacgttctgtcatgtataattattttacgagctggtagcccccagccgtcctagcaagttctattcccatttgtatgaggagagcgacatgactcttctctttttttatcacttcagtctgaatcatccctttcaaacccatgaaaaaagacatgtcattaggcatgtcttttcctttattagcgattatcaatcgtttctggatacatatcatggttcatcatacgatacgatgccatttcttcatatttggtaccaggttttccgtagttcgtgtacgggtcaattgaaataccgcctcttggtgtaaatttgccccatacttcaatgtatcttgggtccatcaattcaatgagatcattcataataatgttcatacaatcctcatggaaatcaccatggttacggaagctgaacaaatacaattttaatgatttactttcgaccatgatgtcatttgggatatagctgatataaactgtcgcaaaatccggctgacctgtttgcggacaaagtgacgtgaattctgggcagttgaatttcacaaaataatctctatttgtatgtttattcggaaatgtttcaagcacttgtggtgcataatcaaacaaataattggtgccttgatttcctagtaaagtgacaccttctaattcttctggttttcttgtcgtcatgtcttctcttcctttctatacgcctcgtttatttccccacaataatgtgtgcagctgcggcagcactcttacacgatttaagtctgggtcttgcgctacttgatcaacaagcgcttcatatttctttaataaatgcgtcaataagtacgcatcatcacctgttgtcgtgtcatcatttcctacttgcaaataaaaaggaagctctggatatttcccatgaacatcttttgcataggctaaatcatgatcgtcaaaaatgacgaccttcaggcttgcatgctctaatctatttccgtttttcagctcatctatgatacgtgtgagtttcgcgaaatctgttttcatatttgaacttggcggtttcggagaaatcgttaaatcatcaattttcaaaaaccagtcctgatacattgtcccttgtgtttcaagcgctgtatcaattccttcttcgtgaagcaaatcaatgagtgactccatttgttttaaaagcgcagggtttccccctgaaatggtgacatgagaaaaagcctgtccacctattctttttaattctttgacaatgtcttctgcgtgaagccactgaatgtcatgctttgctgagccatcccaagtaaaggcggaatcacaccagctgcaagagtagtcacagccagccgttctgacaaacatggttttttgtccaatgaccatcccttctccttgaatggtcggaccaaagatctctaatacaggtatcgccttagccattgtgctcaactcgtttcggccggtaaatgcagtagcttgttggtgtctccctcacaaagacctgaacacataccggtttatttgctaaagtcgataaatatgctgcgactttgtcatggactgtctttgccacaacctctgtagtaggcatcgcgtatggatcggttgatgagaattcctcatgatcattgagcagcgtgtgatcatatttaccatgaataagttttttcagtgtactgaaattgacaaggaaacccgaatcatctaggtcatctccagcaatggttatattgatggtgtacgtatgaccatgtacacggctgcaagcgcctgcatcttctctcgggataaaatgggcagctgatatatgcatatctttgttcaattcaaatgagtatggatgatttgtttgtggatagatctgagaaagcatttattttgcctccttcatttccatatacgtgtcatagccatttttccgaagcttacacgcagggcattccccgcagccattagaaatgatgccattatagcaagtgagcgtttcatttttcacaaaatctaacgcactcagctcgtctgctagcttccatgtttctgctttattaagccacatgagcggtgtatggatgacaaatggtttttccatcgctaaattcactgtgacattacaagacttgacaaactcgtcacggcaatctggatagccgctaaagtctgtttcgcatacacctgtgataatatgtcttgctccgatttgatacgcaagaatagaagcaaaggatagaaacactaagtttcttcctggtacaaatgtggaaggcagctctccttctttttcttcaatatcaatgtcatctcttgttaaggcatttggtgcaagctgattcaaaagagacatatctaatagatggttcttcacacctaacttgtcagcaattcttttagcgacatcaatttcttcttgatgacgctgattataatgaaaggtcacggtttctacctcttcgaattgttgaagtgcccataataaacatgtcgtactgtcttgtcccccgctaaagacaacgactgctttttcatttttcaatttctgttctcctccttttgcagatctataccctcgtacaaaactgcatctgaaaggctcttgaaaacccctgtttttctcaaaagaaaagacacctttacatgtgtatgaggtgtcccagccataaaaaataaaaaatgccacatccaaggatacggcaagtccttagttttttatagagggttttgctagaacctctcccgtttaaacggatttttgttcaattttcacagaagatagtgtaccatatatttttcatgaaggctatcccttctttacttatcaaatgatgcaggcactttctttagaaaaagaaagaggataaaaaagatgctcacatagccaaaaataggataaaccgttgatatcaatgtgccgtaaccaattttactaatcacatagcagcataagagaataagggatatcgtcaagacactgttcattcgtatatacgccctcacttgtctctccagcccatataaattccctatgacggatgtaaagacttctccgaagatcacaaataaataaatgaggtgaatggaatttgctacttgatacacgacctgagccattggaatatcaaacgcctccagcatatctaatgaagaaagagataaaaagcatacaaataaaataattgtcagcatgacgcccccaatcaccgctccctttttgatcaccgcttcagaggtcatttcatttgcgacaggcactaataccgcttgagaaagtgccaaattaaaagcaccatatgagatagctgataaaatccactctccctcacccatttgcagtgcaagaacataactttcactactgctaaaaacgaatgaatcaagaaacacaatcaatgaaaagaaaataagcattggaacgacgagaacattgacaccaaataagccttttgatccttttaaaagcacaataacgctcagaatgatcgttaaaaaaatcccatattccttcgatatgccaagctgctcttcaaatatagcacctgcgccagaaatcatcactgaagtgacgcctagtaaaataaaaaacatgacaacattaatatatcgactggcagctgcgccaaatagaaaccggttcatatcttgataagactctgcttcaattcgtttagaaatgagcatcatttttgctccaagtccagtaaaaatagcgccgctaatcaagattccgaatagtccaatccagccaaaacgaacaaaaaattctacgatttctttccctgtcgcaaacccagctccaaccactgttcctacatatacaaaggcaagctgaaaagcggattcatttgaacgtttcatgtgacccctccgcacccatcactttcgattgtctttttttatcctatgagacaagttccttgaaaagaaggacaaaccatgattaaatgcaaaaaaaggattttacccgcctttgagcaaaacagttgaaagtcaaaataggtcagagtatactatagtcaaagatggtcaaacaacagaccattttctttaacattcattggtcaaataaagtcaaacttttatcataaggaggtcatggcaaatgcgttgtcaacattgtcaagtaaatgaagcaactattcgcctgaatatgcaagtgaattcatcccggagccaaatggttttatgtgaagactgctacacctctttgatggagcaatcaaaaatgaaaatgggacctcaattgttcggaggaagctcattcttctctgagcaagcaggacatacgcaaaacgtagagcagccaaaacaaaaaggcttactcgatgaacttggccgcaatttaacagatggcgcaaatgctggtttaattgatccagtcatcggccgtgatgaagaagtcgcaagagtcattgagattttaaatagaagaaataaaaataatcctgtcctcattggtgaaccaggtgttgggaaaacagcgatcgctgaaggacttgcactgaaaattgcaagtagcgatgtaccaaataaattaaagaacaaacaaatctatttattagatgtctcctcccttgtagcgaatacagggatacgtggtcaatttgaggaaagaatgaagcagttaatcaaagaactgcaaagccgtaaaaatattatcttatttgtagatgaaatccatcttcttgttggcgcaggatctgccgaagggtcaatggatgctggaaacatcttaaaaccagcccttgcacgaggcgagctccagctagtaggtgcgacaacattaaaagaatatcgtcaaattgaaaaagatgccgcacttgaacgacgctttcagcccgttattgtagatgagccaacacaagctgaagcgattgaaattttaaaaggcattcaagataagtacgaaagctaccatggcatcacctattcagacgaagccattcaagcatgtgttcaattatcttcacgatatatccaggaccgtcatttgccggataaagcgattgatttaatggatgaagcaggttcaaaagcgaacctctccattgatgccgcaagtgaagatgaactaacaaatcgtctgagagaaattgctgctgaaaaacaagccgctttaaaagaagaacagtacgaaaaagcagcgaagcttcgagatgaagaagaggccattgaagctagacttcaaaataaaacaaatgacaaagaacatgtcgtcacagcagaagacattcaggccatagtcgaacaaaaaacaggcattcctgttggcaaactgcaagcagacgaacaaaccaaaatgaaagaaattggcgtccgcttaaaagcacgagtgatcggccaagaacatgcggttgaaaaagtagcgaaagctgtgaaaagaagcagagccggcttaaaatcgaaacatagaccaactggctccttcctattcgttggaccaacaggtgtcggaaaaaccgaattgtcaaaaacgctagccgaagaattatttggttcaagagatgcgattatccgtttagatatgagtgaatacatggagaaacactcagtatctaagctcatcggttctcctcctggttatgttggacatgatgaagcgggtcaactaacggaaaaagtgcgcagaaaaccatacagcatcattttgcttgatgaaattgaaaaagcacaccctgatgtgcagcacatgttcctgcaaatcatggaagatggccggttaacagacagccaaggtagaaccgtcagctttaaagatacggtcatcatcatgacaagtaacgcaggcagcacagataaaacggtcaaagttggcttccagtctgatcaggaagaagcaattgaggagcaatcactcattgattcactcagcgcttatttcaagccagaattcttgaaccgttttgacagcatcattcagtttgactcattagatcgagatgatttagtgaagattgtggaccttctgctcaatgagctgtcagaacaattaaaagagcaaaatttaacagtccatgtgacaaatgaagcgaaagaaaaaattgcagaacttggataccatcctgcatttggtgctcgtccactgcgaagaaccattcaagagcatgttgaagatcaaatgacggaaatattacttgaagaagaacagctttcaggatttactgtagaagttgaagataacgaaattgtcgtaaaaaaaggataagtacatcttaagaaggatctacagctccatcatgttgcggtgtctaagttccatccgcacgccgacgctcccccgcctcttttcctttaagataaaagaaaaagaggtggatcacatgatgaattgcagctatgatcttgtcaaaatcatgtatgaggaaaaattaaaagagctgcttttaattgaaactgctcaaagaaattaaaaaagaaactccctttatatcagagggagtttcttttttaaggtaatagaaagcgctttcgtcaaaatttcttcacagaaactgccttaatttgatattcagactaaaacccttctagaagacaccgatattaactatagaaaaagatagttaaaggatttggtgagataatggataaaacatcgttaattggtattattttagcatttattgcactgagtgtcggtatggttttgaaaggtgtaagtctaaccgctcttatcaacccagcggctatattgatcattgtggttgggacgattgcagctgttgtcatcgcattcccatctagtgaaattaagaaaacaccaaaattgttcggcaaaattttcaaagacaacaagcttccaacgattcaagaaatgatccctcttttttcaaactgggcacaaattgcgcgtcgtgaaggtcttttggcattagaagctagcattgaggaagtagatgacgattttcttaagaacggcttaagcatggcggttgacggtcaaagtgcagaatttattcgcgacgtcttaacagaagaagttgacgccatgtcagaaagacatcagtcaggtgcattaatctttacacaagccggtacatacgctccgacgcttggtgtacttggcgccgttgtcggacttattgctgcacttgctaacatgggagatattgaagcacttggacatgcaatcagtgcagccttcgttgccacacttcttgggatttttactgggtatgtgttatggcatccatttgccaacaagctaaagcgtaaatcaaaggaagaagtaaaacttcgtctgattatgatcgaaggaattctttctgttcttgaaggtcaatctccaaaagtgattgaacaaaaacttctcatgtacttaccagcgaaagaacgtgcaaatcttgtcattgaagaaggagaaaaacaaaatggctaggaaacgtaaaaaacatgatcacgatgaccatgtagatgaatcttggctgatcccttatgccgatcttctgacgcttctgctcgctctcttcattgtgctttttgcatctagttcgattgatgcggcaaagtatgaacagatggccaagtcttttaatgtcgtctttacgggcggtactggtgtcatggatcaaaccagcatgcaaagtactgaagaaactgaaaatagcaaccagaccaaaaaagcagctgaagaagaagatgaagaagcgaaagcaaaagctcgagatcatgccgttctcacaaaggtcaaaaagcaagtggattccttcattgccaataagaaacttggagctaagctcgaaacaaagctcacggacgaaggtttgctcattacgatagaagacagtatcttctttgattctggccgggcggttattcgtcctcaagatgtccctttggcaaaggaaatctcaaaactactcgtcattaaccccgctcgtgacatcgtcattagcggacatactgataatgtaccgatcagaaattcagattttgaatccaactggtatttaagtgccatacgtgctgtaaactttttgagtattcttcttgagaacagcaatttaaaccaagagaactttagtacaaaaggtttcggtgaatttaagcccatcgcttcaaatgatacagcagaaggcagaagtaaaaaccggcgcgtagaagtacttattttaccgatcgagaaaaaagcaaaataaaaaaggaagccctcggcttccttttttatttattctttatgatcatataaatgttttgcacgcagtcccacatgtttaagcatgtcaatgcaggcatccttctcttcttcgctcaggacactgatcatctcatgaatttctttcgcatgatctgggaagatatcatcaagcaaagctcgtccctgctcggtaatatgtgcaaatgtgaccctccggtcttctgcacaggccttacgactgaggagttctttcttctccaatttatcgaccacatacgtgatgctgccgcttgcaagtaaaatcttatcaccgatttgctgaagcggctgatcccctttatgatacagtaattctaatactgcaaattcagtcggattcagcccgtgcttcacaatatgtttgttcatgtgatgattaattgagcgataggcacgtgataatacaataaataatttcaaagatttttcaacattatgattttccatttttttatcatcctttatgaaatgcaacccactaatgtgacattaataaacaataagtaaaatgtcaacatcttgatctatctttagcatgaaaatgagaccagaacgaatcacctaattttttaaaaatcacacaagtcatcgtaataaagataggttcaatgctataataagtctattaggtaatacgttggagcgatgaatgatgagtatattgaaagggttttggaagaagatcaggctgtaccttattttggtcatgattccaaccctaatcattagttattttatctacgaaaaagaaacggaaaaaatcgacttaaaaaacaaacaaactgctacacttatgttaaatattcacaaaaaccaaatgaattatttaattagtgaaacagaagcgagattaacttcacttgccatgggatttgaccagcctctcgagacgaaaaaggtacaaaacatcctagagaaaatctataaacaagaacctcgtttttcgggtctgtatctcctagacaaaaaaggaaatgtaacagtaagcaccacaccgttaaaggaaaaaatcaacctatcattcagagattactttaagcgcattcaagtgaccaagcagacggtgatcacagataattatgtgagccgaattacaaaacagcggattctttccatttgtgtgcctgtgctggatgaaaacgaagaagtcaccaatgtactagtcgccgccattcaaattgattatttaagaaatattatgaatgtattgaaccctgatcttcattttaagatgctgaatcaaaatggacatgtcgtgtttacaagtggtccacagccagcatcagaaaatggcagtaccgtgtctacatatttagatgaaaacagctggaagctggaggtctatccgcagcgtgcttctacaggtgaagtgctgtctgttatgctgatccccttatccagtgcttttattttattaaatattttattcacacttgttcaatatatcattttaaggcggcaaacccagcaggagcgtcaccaaaatgaagcgcaaaagcttgaattaatcgggaccctcgcagcaagtacggcacacgaaattcgcaacccattaacagggattagtggatttatacagcttttgcaaaagaagtatcactctgaagaagatcagctctatttttctgtcattgaagaagaaattaaacgaatcaaccaaatcgtcagtgagtttcttgtattagggaaaccaacggcagaaaaatggcagaataactctgtaaaagaaattgtaagtgagatcatgccgatcgttttctctgaggcgaacctttataatgttgaggttgatttgcaaattaatacgattcaagatgttggggtatattgcacaaaggatcacattaaacaagtcgtattaaatgtagcgaagaactcgttagaagcgatgccaaatggcggtcatttgaagattttgattgaggctgaaaaagaacatgtcattattaaagtgaaagatacaggcgagggcataccagaagaaatgttaaaacatatcttcctcccttttattacgtcgaaggaaaaagggacaggtcttggactagtcgtgtgtaaacgaatcatttcgatgtatggcggaacaattgatatcgagagcgaagtgaataaaggaacaaccgtcatgatcatgcttccttctgctcactcagcatagctgaaacattcagccggttttgcttaggcaagaccggttttttcatgtcaataagagggacggttcacagatagaaggctcatttgagagacaagatcatgaaaggttgcaacagattgtttctcatgaaaaagaagatactgatactcattcatcaggttgtccagttcttgactatatttaattgtcgtctcaccagtgtagccttctgcttgagcagcttctaccatctgttttctcttctcatcaattgacattagcaattgttcttttcttacataactattcatgatctcagctcccgcaataaattcgactgtctgtgctcaaaatgatccgacaccaaaattatactttatttgtaaattaaattaaatatgcttattttatttaattttttacagcctaaagacctcttacccaatcttatttgggggtaaacttcaaatttgggcaggactgacacatggattaaacagaattttatcctatgcagaagctcaaaatcaactattttctttctcattttatacctattttcctaaaaaaaagctgatcttccgcctcatgcggaatgatcagctcctgtcattaaaccgtttcttcctcgtaaattggcacccagccctcagttgtgacaaatatgcgaactgcgaccacttttcgatcctcttgaagtgtaaagtagtgacgaatatgcggcggaacagaaattaaatcaccaggattcagtctcacatcaaaaaagacgccatccttcccctgaatggcaaagattccatgaccgcttacgataaagcgtacttcgtcatctgtatggtgatgctcacgctgaaaattttggagcaagtcatctaggtttggtgtggcatcagataatgaaatcacatcctgcgctttgtatcctcgtttttcagatatactctcgatttccttttggaaaacagtcaaaatctcttccttttcctcatctgttaaatcatacttttctgctaatcggtttggcagctttgcaatatcccaatgttcataaatgaccccttgattttctaaataggctgccacctcttgctcgctttcaagtaatgtgttctcttcattatgaatcaaaatcgtcgccatgtgcttttcctcctttttatgtgacaagctgcttttgataaagcgttaattttaagtagtagctaaacaaaaattcatacgcctctaatactcgttttgcttcagaggctgtttttccccagactgtgatgccgtgatttcgaatgagcacagcacctgattccgactcttcagtgagatgctttgcaaattgtgctgcaagttgcggaatatgggctggattttcaataatcggtaatgatacttctgcatcctcttcccagaaaccaagcgctttgatgatttcgtttcctttgaaacgaacctcgcccttatccccatacagctcagagattacattattatcgattgtatggacatgcagacagcagcctgctttcgtccgttcatacacgtacgtgtgaagcagtgtttcagctgatggtctaagcggttggtcaggatcaacaggcttacctgctgcatttactaaaacaaagtcttcatctgtttcttttcgtttatctttgccgcttgccgtcaccaaaaacgtgattggatcatccgacaccttgattgataaattgccgcttgttccgtaaaaccagtctctttgtgccagttcacgtttgacgtcagctagctcctgccagcgcttgttctttgcgtctgccatttcttcacttcctttatttgatcaaattgtgctttaagatcaataaatgtttcaaactcttcatgaacaagcccgagctctttacattcgtttagcaagtagtcacgcgcaaatgtgagatccgcatgctttgccgcctccacatcggtgactgaatccccaatcatgataatgaagtcattctcactggtcagctctcgaatgattgacggcttgcagcagccgcagccattttgacactgcgaatcgcaggcatgcggccattcaatctgaatatactcttccccaaatgaggcatgattgcaataaatatcgtctctatccacaatgccctcgagtatgggataaacaaaaaaatccatcccgccgcttagcacatagaagggaatatcagccttttttacatgatcaacaaatggcttgaatccttctcgaatctctgtatcttctaaaataaacgattgaatggcttctttttgatcactcgtcagtaattgaaacatctgcccgacgccttcttgaatggtgatctcctttgtgagaacatcgtccttcagcttcgtccattcacttggtgcgaactgtttcatgatgcgaatgatattatcatttttcgtaatggttccatcaaaatcacaacatacaattggttttttcatttattctgctacccttccccatagttcaagtgctgcttttaagtcttggcaagaagcttccttctcttggatcgactctccatgtatcaccgcatcaatgatcgatcgaaatgctttccctccgccaatgcctccacgcggatggccgtgaattcctccgccagcatttatcacatgatcgagtccaaaatctttgatcaatactggaaccattccaggatgaatccctgctgacgggactgggaacgttttttgaaccgaatcctcttttacacaagcttcatagattccaaaggcatcttttttcggaagtgcgaccgacccatacggtgagggaaaaagacttaaatcagcgccagcatatcgatttaatttacctaaaagaagagaatgggagaatccatattcaggcgatgatgtcaaagcaccgcttactgcgggatgggccataataggcaatcgaatatctggatcctcaactaagctttgcatgacatctagcccgtaggcaaagacattgaataagagggcatccgctccaagctcagcagcctttcttgctcgatccctcagttcaaaggttctgcctgttaaattaacggcatatagcgttcggtgccctgtctcttcatatgtttcttttaatatcttttttccttctttgattcgctcttcaaaaggggctagcgggctctcaaataaaatttcatcgtctttgataaagtcaacgccgcctaatgcttgtaaacggagctgttcttttaaatctgccatatcacggccaatgacacctttaaaaatgctcatcaacaaaggtcgatcaaacacgcctgttttttttcgtatgccatcaattccaaataccggtcctggtaaacttcttttcaatctatctgaaaattgaatgtcgactagcttcacttttccatctagtgaaagctttccaaagatcgtcgtcaaaacggccggtatatccgctgaaaagttagcctcaggataagcaatggtcacctcagattgatataggccattttcggctggagcaaacttttctgataccttttctacccggcctttatgcttttgaagctgcttttttttgagctgcggcaaatccgtccatgatccaactgttagaccaagcgcgatctgctccgcttttcggttcacttgttcatcctctcgatgtgttaatacgtatgttgccagtaattcactcactaggaatcccctttcgattgcgtcatgcatatggtcaataaaaaaacctcttcaagtgctttatcagcgcctaaaagaggttgtttcgtgtcattcatccgaatcttatctctcagcgcttgctgcaagaattagcaccgtgcttcatggaagtcggttgccgggcttcattgggctagtccctctgcctactcttgataagaatattcaattttcttaaatattgtctgaattatcgcaccgtttattcatgttgtcaatggcttattttcaaacagattcaaggcatcgattcgccgagcggcttcttttaaccgctcctcatttgttaaaagtcctactctcacgtatccttcaccgtgagtaccaaacccattccccggtgccacaaccacatgcgctttctctaataatacgccagcaaaagattcagatgtatacccttctggcacctttagccaagcaaaaaacgacccctttggtgcagtgacctcccagccaatctccttgcaggcagcaatccacacatttcgccgattctcatatcgttcattttgcacctgtacacacgtttggtcgcttaacaaagcttccgctgctgcatcttgagtggctttgaacagtgaaacaaacaggtgatcctgataaagctcaatcgcttcaataacagatggatttcctgctgcaaaccctactctccagccggccatattatacgttttagacaatgtataaatttcaatccccgtctctttcgctccatctgtttgcaaaaagctgatcggcttttccccatcaaacccaataccgccataagcaaaatcatggacaacacagagcttgtgatcttttgcgaatgtaacggtttcttcaaaaaatgaacggcttgccgtggcacctgtcgggttgttgggataatttaaatacatcaactttgccttttccttaacatcctcaggcaacctgtcatagtcaggtaaaaaatcattttgttcaagaagcggcatcgtcaccatttgagctccagcaagcacggcacctgaccagtaatcaggataacctgggtctggaacaagaagtgtgtcacccggattcagcaggcattgcggcagctcaacaagtcccgctttcccgccaaataaaatcgcaatttccgtcatcggatcaagcgtgacaccatattctctttcataaaaggcagcggcagccttttttaatttcgctgttccgcggaatgacgagtattgatgattttcaggttttaataccgcttcctgcatggcttttacaatgtgcgcgggcgttggctggtcaggatttccctgccctaaattaatcatatctgcgccctcctgcacttttttctgaaccttttggacaagggttgcaaaaaattgtgtcggtaattgtttcagtacatctgaatgctggaattccatttttcttcaccttctattcaagttacatagcaatacaaacactgtaatggattgttttacgaattgtaaagcaatttcgaaaaaggattgacatgtgaagcgtagctctgataatatcttgaattaagaaatgcaaacaaacacgaaacaattacatattgatttctcttatcgagagttgggcgagggatttggccttttgaccccaacagcaaccgaccgttaataccactgtgaagtggggcgcagcaagtaagcgccaagacaattgtcttatagggcacggtgctaattccatcagacgtatgtgctgagagataagagaggctttgagtatacacaacatcaagcctctttctctcaggagaaagaggcttttttatatgatttggaggggaagcaattggttacacttacggcatcatatgaagaattaacagaaagctcggcagttgcactcgcaattagacttggcttgatccaagaaagcagtcatttgacatgtacggaaatcggtgacgggaatttaaattatgtctttcatatttttgatcataaacaagaaaaaggtttgatcatcaagcaggcactgccttacgccaaggtggtcggagagagctggccgcttacattagaccgtgcgagaatcgaaagtgctgccctgatcaagcagtcagaatatacgccgcacctcgtaccagcagtctattattcagatacagctctggctgtgacggcaatggaggatctatcacacctagaaatcgtcagaaaagggctaattgccggaaaacaatatccgcatttatctgatcatgtcggagaatttttaggaaaaacactattttacacttctgactttgccacaaatcctaaaatcaaaaaacaatttgtaaagcaatttacgaatccggacctttgtgacattaccgaaaagctcgtcttcacagatcctttctttgatagcggcacaaatgatttcgaagaagaattaagagaagctgccgaagcgctctgggcagatcttgcagtgcaggcaaaagcagctgaattgaagcgtattttcctgacatctgccgaaacattagttcatggagatcttcatacaggcagtatttttgcaagtgagacggaaacaaaaatcattgatccagaattcgctttttatggtcccttcggattcgatatcggtcactttatcgctaacctgttcctaaatgctttgtctcgtgagaatgaacatgatcaacagcacctttttgaccatgtcgtcaatgtatgggcgaccttcaaagaagtgttcgcaaaagcttggaaagaagacagcattgaagcatttagtgtatctgacagctttttagaaacaacctttgaccgtattttaaaagaagcgacaggctttgcgggctgtgagcttgtccgccgaacgatcggtcttgcccatgccgctgatctcgatgcaattccatcaccatctagacggattcagcagaaaaaagcagcacttacgctcggaaaaacattcatcaaacaatatcatgcagtggaaacagcgtctgacctcgtcgcattattccagcaatctgtaaaggagtgacgggttttgtctaaagaatttgaagtcccccgttctgtcgaatgggaagaaaaccattttaacattttgaatcagcaaaaattaccggcagaaaccgtatttgaacatctatatacaaaagaagacgtgtatgatgccattgtcacgttaaaagtgcggggagcacctgccattggcatcacagcagcttttggactagcgctcagtgcccaagacattgagacagaagatattgatgtgtttaaacaagaagtcattcagatcaaagaatatttaaacagtgctcgtccaaccgctgtgaatctagcctgggcattagatcgattattgcagcgcattgagcgtgcagcctcggtcaatgcagccaaaacagaccttgtccatgaagccattcaaattcaaattgaagatgaagaaacatgcagacaaatcggtcaaaatgcactccagctctttaaatcgggtgatcggattatgacaatatgcaatgcaggctctatcgccacgagccgttacggaacagcccttgctccattctatttagccaaaaagaaaaatctcgatcttcacatttatgcctgtgaaacacgccctgttcttcaaggggctaggctgacaacttgggagctcatgcaaggcggcgtagatgtgacgctcatcacagataacatggcagcccatacgatgaaagaaaagcaaatttctgcagttattgttggagctgatcgtattgcccgtaatggagatgcggcgaataagattggcacgttaagtcttgctattttagccaagcattttcaaattccgttttttatagctgcaccgctttctacctttgatgtctcaaccaaagacggggcagatattccaatagaagagcgcgatcctctggaagtaaaggaatttaacggcgtccaaattgcaccgcctgatgttcaggtattcaatcccgcctttgatgtcactcctcaccatctcatttcagggattattacagagaaagggattatcacgtcgaactatacagaagagattgatgctctgtttgctggaagcatctcactctgatcataaaaaaagcgccgtgtacttattatttaagagcaccgcgcttttttatttcattcgtttttgctaagatttcttttttctgttcttctgtcaaaacgttcattttgacacatagtgatgtgatggcatacattttattttttttgtcccaaaacattccgtagcgccctcctttttccctcaaccaacttttttagcttaataaaaggatatgtcgcttggaaaacatttggaacaggtcaatcgatttatttttgaacaaatgggataccttctaattcaagcagaaccgctttcatgtctgtcttcgttcctgcatagcccgttagagaacggtcttttccaatcactctgtgacagggaataaaaataggtaatgcattgcgtctgttggcttgtccaatcgctctcactgcctttgggttaccaatcgcttctgcaatgtctgcatagctttttgattcaccatacggaatagtcgaaagtgcttcccacacttgctcttgaaacgaagttcccttttgcttgagcgggagatcgaatacttggcgctcccccttgaaatattcatccagctgctttttcgcttcttgtaatacagacgtttcttcttcttttagattggcttcctgctttttttctaaaaacggctcatcatcaaacatcacctcgatgatggcatcatctttttctagtatgtataatgccccaattggtgcgtgatagacggtataatacacgttaatgctctccttcttgtttcttctgcctaagtggcagcgtgagatggaagacggttcctaccccttcctcactttctacctcaatggttccttgatgctcttcaataattttataactaaccattaagccaagtccagttcctctttcttttgtcgtataaaatggttcccctaaacgcttcagcttgtcctctgccattccgcagccttcatcccgcaatgaaatgacaatatgctcttcgcccttccgctgaatgctcacatagacatttccttttctcggcatgacttcaattgcattttttaaaatgttaataaagacttgttttaattggttttgttcacaataaatgagcggaatctcatccattacattgagatgcatttgaacgttgccaaggttcgcctgtgcgtgtagcagatccatcgtgtctttcacaatttgcacgacatttttttcttcatatacgatagcttgcggcttcgctaaaatcaaaaattcggtgatgatcgattcaattcttttgagctctgatgtgatgacattgaaatagagcgaatactccccttctatatttccttttaacagctgaataaagccttttaatgctgtcatcgggtttctaatttcatgcgcaattccagcggcaagctctccgaccacatgaagagtatctgattttctgacccgctcttctaattccttccgctctgtcacatctctaaagatcgctaaattcatattatgaataatgttacgtttaaaagagaattccaatatccgctgatctggatggttcagcacaaacggcacttcattgtccatttcatctaatgacatcgtctgggcaggctgtgccaaatgttcaatttgataaggcgcaaggatatggaatagattcatttccgttaaatgatcatctttcaacccgagcagctcgcttgcggatggattgacttcgataatgtggtattggttatcaaaaagaacaatgccgtccattgatccattaaatactttacggaatttgagctcactttcgcgcagctcctcctccatcctttttcgatcactcacattacgtaaaatggttaagtgctgtccttctaataccgcatgctttgatgtaaactcgagctctttaaactgaccatttgccattctgaacaaaagttcttcccttatttcatgattccgaatatatcgtcttctagtcggtctatatctccgatcagatttcacaagaaagtctgtgagttttttgccaatcagtgaatgcataggcaattcaaaaatgcggcaagctgattcattggctctcacaatctctccatcatccgcccatatgatgatcgcatccattgcattttcaaaaatttctctaaagcgttcctcactttttaacagcttctcttccattaaccttttttctgtaatatcccgcatgatggacatataaaaaccgctcatcacatttgatgtgatggtgagctcgaataatttgtactggccagattgaagggtaacgggaagttctcccttggctttccctgtttctttcagtgacgttaaaaggtgctgcaaggctggaagattttcatcttcgacaaattcttttaaataacgatcggttaaatccgtcttttgcagttcaaagctctgacaaaaagagtgattggcgtcgattatgcagccatcctgatcaaaaatgaccatgccgtcaatggctcggtcaaacaaatctttgaacagctgctcattcatggatcgttctcgttctaatattttctttgaggaaatatctcgcatgaccactatatattgctgattcaagacatcatgctctgcgacaaattcaatgtattttgtttcaccgttttcaagctgaatggaaatttctcttcttaatgttcctttacgaaaaaataaatcaagggagcattcaattttgtctttcgggatgccgtataggaaatctagaacggatttattgaggaggtcttctttcgatgtctgtacaagcctgcatgtcgcttcattggcttggataatattgaggtgttgatcaaatatgaaaatggcatctaacgtcttatttaacagcattttttgctgcatcaactctgttcgcaaatattcgttctctttttctaattttctgatatcttctgcgccatcgagcgtttcagtcattctcttacactccttttccagcctcattcctctacaatatttctacaatattttcattgttccttcattcgactcataaaaaaagataactttttacacgaagtctgtctcttttgtttcatttggatgacaggattgaaccgcgattctcttttcttacgcttcttttacaaccgttctacaatttcacatcaaatagcgaaatgagccaaaatgtattttaaaatggggcaaatacgggaacagtgcacttagaacatttatggttgaaatcaagcaggaaaggtgatgttatggcatcttcacgagatagttattttgataatgcgaaatttcttctgatttttctagttgtttttggtcatttgttacgatcattcattcatgataatgattggatactttatttatacaagtttatttatacttttcacatgcctgcctttattttggtttccggcttctttgcaaaagggtttagaaagccaggttttatgaaaaaagttgctgttaagctgatcatcccatatttcatttttcaggtgatctattccgtttactattatctcttacaggatcaaagcatggccaatttaaatccaattgatccgcaatggtctttatggtttttaattagtttattcttttggaatttgctgctcattcctttttctaaactgccatttcactgggcgatgatcgtcagtttgtcgattgcgttacttgtcggttacgtggacagtattagcaatacgctgagcttatcacgtacgtttgtctttttgccgatgtttttagctggcttctatttaaaaaagcagcattttgaattcatccgtacaagcaaaggaaagctggcagcactccttgtattaatggctgtattcttgttttgctatttctatgaatttgattattccttcttatttggatcacagtcatatgcttctcttggtgatgagggagtgattgcggcaatgaaacgaatggcatggtatctgcttgcattcggcgctacattcagcttctttgctttagtgccaacacgccgtttcttctttacaaaatggggcacaagaacgttatatgtgtatttattacatggctttgttatcaagcttcttagaacgacttggtttgatgactgggccctgaatgcagcaagtgtgctcatgttattgctgctgaccattctgcttaccttcaccctgtctagcacatttgttaaaaccgttgcacagccagtgattgagctcaaaatgaccagtctcacgcgtacaatcaccggcagacaaggcagttatagcaaataaaaaacgatcctgagcggatcgttttttctatttttcattcatatgtccattgtggcattcatcatctttcttaggttttacaagagtatcaatccatttgctgctgttgatatctccaagctcactgccaaattcctcttctaagatatctgggtccattggctttttatggtctttcatgtccttgctttttacatgcttcttagtcacgagatcctcccccttgcttccctttatgagaatttcgatttgcctgacggtctcttgattgttcatcaaattgggtttgtccttgatcatgtgccatgctctctgtcggtgtcatattatttgtcagtgcttcgtttttcgctgcttttcttttcatttggaatcagtccttttttaacatatttagttcttctcttaattggtctagaagttccttcatttgtttgaccgtcacaggcttttcctctggctttaactcatagccgatttgtccattggcttctagggtggcttttttgagactgctgatctctgtaatgccttgctgctttaaccgcattttaaattgatctcttgtaagcctcgttttcttcagcttgtgatcaagcagttctccgtcttgtagaatcaccaccgatttccctgaaactaatttttcaaagaaatcagattgaatcgacagcttctccattatgacaagcgccacaataaagatagcggctgcataaatggtttcaagtaaattgtgctctataaagggttggataataatcgatccgattgaaatcataatcactgtttgttgaacagttaattgactaatggatttaggccctgctattctcagcagtaaggtaccaactagcagcataacaatcgctttccataacacatccagcacgtctcgttcacctcttacctatagattgcgaacatcccatgtgatttagccagttagataatggaaataaaaaaaacagcattcgctcggaatgctgtttagccgatgatgacacgctctttcggataatgataattcgcttcgctttctcttcggccaattaaatataagaagcttggaatgccgattcgcccaataaacatgaccaccataatgatgcactttccgaaaacagagagctcagaggtaatccctagtgataaacctgttgttccgaaagcagaacagacttcaaataaattttgaagaagcgtattatgctcagataaggttaataagaatgtagcaccaaacaccaatataaaggccatcatcgtcaccataagagatttgttaatatctgcttgatgcagctctcttttgaaaattttaatggacttatttccccgagcaaaatgaaacagtgcaagtaaattaagggcaaaggtggttgtccgaattccgccccccaccgagcttggagatgccccgataaacatgagcagacataaaaataacagcgttggttctgtcaattgagtaatatctaatgtggaaagtcccccacttcttgtggccgtcgattggaacaatgaataaaacaaaacttcgtgccagctcttccctaaaaacgtaaaccgggcttcaagagcataaatcccaatagcaccaacaatgactaagctgccaaacgtaatcgttgtgatttttgtaaacaacgagaacgatgcgtgctttcggtcctgattaaataagtaatcctttacttccacgagcacaggaaagccaatagctccaaagatgatcagcagcatcgtaataaattggacgaaataatcatctttgtatgggatgagcgagttccctgtaatatcgaagcccccattggtggtcgcactaatactcgagaagaagccatgtaagaatgctgtctgtacatcgtaatatttgagaaaatacatacttaaaatcagaccgcctacaaactcaatgagcaaaattaaatataagacctgcttcattagtttcacaattcctgataaattgctctggttttgatctgccatgatgagctttctttctttaatcccgatcctttttcgcatgacaatccacacaaaggtaccgagcgtcataatgccgatacctccgatttgaaggacaaacgcaaggatccacatacctgccacactaaatgtttgcgaggtatcaaccacagtaagtcctgtgacacttaccgcactcaccgccgtaaataatgcatcgataaatgtccacttcaccccatcttgatgagcgactggcaaactgagaagaataaatgagacggttacagcgagaaaataataaagggcaatcagctggaaagccgatagccggtcaattagctttttaattgggttcattgtcattccttcttttaactttcatttttcaatacttatcattttaatgaaaagagacatgattttaaagatattttatgctttatttactttttcatcaaaaaagaaaagacatcctgtaacagaatgtcttttcgtctctcttattttgcttctagtcttctaattctttcgtttaaatcagggtgtgttgagaaaagagaagcttttcgtttaccactgattttaagcgtagcaactgctgtttgatcatcatctttgattcttgacgtatacgcctcaagtgagcgaagcgcatgaatcattttatctttaccggcaaggtcagctccgccgcggtctgcatggaattcacggtgtctagaatatgcaaacacgacaaggcttcctaggacagagaaaatgatttggaaaacaatcactgcaataaaatgaacaatcggcacaagctcttcacgcggaacaaagcggcttgcgatccatgccgcaattcttgaaaggaagacaacgaacgtgttgacgatcccttgaagcagcgtcattgtcaccatgtctccgttcgcaacgtgagcaatttcgtgagcgatgacaccttcaactgctgcatcatccatttcatgaagtaatccagtggaaaccgcaacaagtgatcttctcttagaaggacctgtcgcaaaagcatttacttcagatgattgataaatcccaacctcaggcattttagaaaggcctgctgctcttgataatctgtgcacgcggtcaacaagctgctgctcatcatatgttaatgaatccttttcaggatttaacacacgcacacccatcatcatttttgccatccagcgagacatcgctagtgacatgaacgagccaacaaaaccaacaactgcactgaatactaacagtgccacaaaattaattccaccgtctgctcctatataagaaccaacaccagttgctgcactaataaccgacagtacaataccaatcgtagtgataacaagaatgttcgttaatataaacagaaatattcttttacccatacataacctccgctgtcatattaagttcatttgaacttattaataaaattataaaaataaacgtctcaaattgcaaggaaaaaggaatcatttcctctatttatcataacggcttaagccccgtcacttcaatatttacgacataagccacagctgaaaagtgaataaattgtgacgccgctttctggattttagtttattttgcatttttatcaaaaagagattatgatgttgaattagataaattatgacgtttttgacatacaaacgaggtggaacaatgggtgcttttaaattaacgagaattgacatgacaagtcttctttattctctaaaaggagagggagatctgactccgcttcagctattaaatttatctgtaaaaaaagacaaacaacacgaacttgacgagctcatcatcccttctttttttgagaggcttgaaaggcggaaacaaaaatcagagcatggactctccacaaatgaaattgtagaattaggaaatctatgcgaactgacttctcttaaatcgacagcgattcaaaactggatcaagcgtgatattaaagatatgattggccaccctgagcttggaaagaagtactcaattgatcaggtcgttattttattaattgtgagagatttaaaatcagtttttgactttgatgccatccggaccatcttatctgccttatttaacacgattacggatcgaactgatgatattattagtccactgcgtttttatgaagcatatgcgcatgtccttgattttatttatcatcatactccttttccgttaaaagaaacaaacttacgggaaatcacagaggaacagacagataagctccgtgaagaatttgctgaattgacgcagcatcaatggcatttgatcaaaggtattatcagttcaaccgttttttctgtctttacttcacacttgcaaagtacggcacaagaaatgatgtttcatacactgcagcatcaggattaaaaaagaaccgaggtgaatcatcacctcggtttttttgtacagcaattgccagcataattacatgtcgttttcttcaaaataagaaggcgcaacaaacataaggtgaaaggaggaatacggacatggcaaatcgaaatcaacttcttgttcctggagtagaacaagcattagatcaatttaaatacgagatcgctcaagaatttggcgtgactctcggttcagatacagtcgcacgtgcaaacggttctgttggcggcgaaattacaaaaagactcgttcaacaggctcaatcacaaatgggcaatcaatctaaataaaaacatggtgaaatacgccggagctattctggcgtttttttattgctcatatgtgtgctcatagcggttctcacgatacggggacggtgcaccttttccttgcttcttcacatgttctttttttcgttcagcggacggctgtttctgatccctgtcgtttttttttacgtgcttttcagcaccaccacgtgatgtgccgtttggactccttttgtcatcaggttccgttgagtgattttttttttgttctttatcgatagaacgatccttttcttcctttatttgattgtctttgcttttatcatcaggttttgcttggtgaggcttttgaatagatccttgctcttccctctcttgatccttctgctgttcgtcttcagcttcaggagcctcttgatctggcttcaactcttcgctatcgtctgtcttgacgtcttcttgtttgtctttgtctgcttgatcttcatcatcttttttaggctcttcttctttgacagcatcactctctgctgcgtcttcatcctgttgaatgtcttcttgttctttgtcttgcatttcttgatttctgatatatgtgcctgttgaaatgcctgccttttgagctttttctcttgtttccaggtcactttctacagtttctagcttgtaatcgcgcttttgatattcaccagagatggtgttaattttacttttgacgttggttttatatgtatggtcctgcttattttcataaaccgttgaaatataaatgctcttagaatggttcacgtaaccttttttgtcacagtcatctatgatttcctgcacgactttggtcatgtcgtttttttctaaacccttcatactggccagtacttgtttcgcatctttattcagtggcgtgacaccgatcacttgataattgtgatcaagctttagttcaaagcttggattaatgtcaatcgtcatatatgcatatgctttttgacttgagaacgatggcatcatagtgaaaatcacgacaataatcgctgcgattgataggattcctgcatttaatggacgtaaacgaagcaagtcaaaaaaaccggctttttttctttcgagacgtgattcattcggaaatgtcacttcttgaccgatttcataatcttgctgttcatattttgtccgcagaaattgtccatcaggggtcagcagcgtgacatattttttgtttttctctactataatgcctcttctcatgaattaagcacccctttaaggtaatctttcaaatacacataatcacccgtcataatgatcgccatcgcaatgatatattttctatttctttcaatcgttttgcggctgacttccactagcttttcaagctgtttgactggcaattgttttttctgaaataaaatggttcggagctcatcgtgttcaacgagtgtgtgggctactttaatggcattttgcctggcatctgcatgctttggtgaatgttcaagcagctcttgaaacgtgagaccgtatactttcaatcgttctttaaaatgttcaatttcttctcttctgtgttcttgttcaattaaacgtctatattcgtttgtagacagctctgcttcaatcatgctttgagagtactcgccattttcactttcttgcaggtccatttgaaccgttggcgcatttctcgcttcttttcgaatatagtcgatcacttttcttttaataattaattctgcgaaagcaaggagtgagtttcctttttcggcagagtatttttctatcgcttcattaaaggcaattaagcctatgctgaattcatcatctttttcatctatatatcgtttacaaacggatgaaaccgtcttagcgacaaatggtttgtattgctctattaatgcattttgcagctcgatatcaccttgttgaatactaatagccgactgctctaatgtttgctttttctttccttttttaaacaaaaggctaagcaatggtttcacctcagttctccctatattactcatttatgatagctaatttatgagggaagcgcaaaggaagaaatgaggaattcatttcctgttactcaattgtgacatgaatatcatcatctactttacaatgtttcgtctaaaagcaaagaaataagggggtatctcccccttatttgtaatatatgtgttatgaaaatgaaatgatatttctttcaaaaaacctactcttctaggcgcccctcttgtttttccttgttttgttgcccgccttttcttgatggacttgataaaaaccagccaaatgctgcaattgcgagaagcactgtccagaaaatcactttccataatgttgaatgaataaaatgagaggacacgataccaatggctggatgtgacagtgtataaagcgtgagcttcacaccaacccatccgacaatgacaaaagctgctgtttctaggctcggtcttgttttgagcagtttcacaaagacagtcgctgcaaatctcatgatgatcaaaccgatgataccacctaagagaatgacaataaattgaccgccatcaagtccaccgatttgcggaagacttgttttcggcaatgttacggctaatgcgaccgccgctaagatggaatcgacagcaaaggcgatgtcagcaagctcgacttttacgactgttgcccagaagccgctttgcttcatgtttgtgtctgattcctttttcttaaatacgtgcgattttaaaatatggtgaatggaaatataaagaagataaattgcaccaatggcttgaacttgccacacatctactaaaaacgaaataagaaacagggagccaaatcgcatgacaaacgcacccgcaagtccgtaaaacaacgccttttttctttgcttttcaggaaggtgtttcaccatcacagccatgaccagcgcattgtcagcggctaaaatcccttctaatccaatcagtacgagaagaacccatccgtactctaaaataattgctgcatccatcatcattcctccttgtttttatctattgtcccacaacagacaaaggcttatgaatgcaaaaaagacctttgcctgtaatggcaaaggtcttgctagacatgtgatatgtagaatcatgccaacaaagccgatggaacttaagtccatgtaatgacgactttgtttccggtaaaaaccggacgctactcccctttggtgggatttaagaatatttagattacttatattttaatcaatagacactgtattgtcaacaggtgactttcacctcgggtccagtgattaggcagttggtgtttctgcttttctttttctacgtttcatccatatatacatcgcgaaaagcaacacaatcccgatcccaatcggcagaagatatggatctaacattgcgccaacctctttccagttctccccgagcacaaatccaagatacacatatacaaatgtaataggcgtaattgctaaaaacgtgtacaggcaaaagacccacacattcatcttggcaataccgcacgggatggaaataagcgttctgactcctggaataaatcggccgctaaatgcgacgaatccaccatgctttttaaagaaggcatccgatttatcaagtgactccggtttaacaaaaaagtacttcccatatttatttaaaaagggtctgccgccataacgtcctaaccagtacaaggtcaaaggaccagccacgccgccaatagagccggctgccacaacacctatgaaagccatgtccccttctgagacccagtaacccgcaagaggcagaaccacttcagcaggaacaaattcaatacataatgctaggaagatgccaaagtacgacaagttcttaaaggcatcagctaaagaaataataaaatcttcgatgtttatcaatccctttcacacataatcgtttaactgattctatctcttttagaatcgcacatatattaaacgaataaaaccgaagaaacgattcacttttcgtcgtttttttacattaaatttgattttactataaaagacaagtgaagaaaacgttgattgtggtatttaagtgaaggaaaagtgaacacagaagccattcgatccgatatattaagtatacgtctgttttaagatactggaggttttcttacatgacccatttaacaggaagctacaatggatggcttgtctttctgtcaatcgcagtcgccgctgtcgcctcctactcagctcttcatttagccagccgagtagcacagtcaagcggtgcaaagaaaaaggtatggctgatcgttggtgccatgatcatggggatggggatatggtcgatgcattttatcggcatgatggcatttcacatgcatgctggtatcacatatgaaacacccttgctcattttatcgattttggcatcttttgccgggtccttgatcgcattcacaatatgcattcaagaacagctctccacaagacggctgctcattagttcaatcaccttgggctcagctatttgcagtatgcattatcttggaatggaatcaatggccaatgtctccatcagctatgatccagtcctcttttttctttcgtttttcattgctgcgatagcgtctttcttttcgcttcatctcttttttcggctccatcgatccgggaaaaaacaggaggatcatctgttaaaaatagctggtgcactcgtgatgggcggggctgtttctgggatgcattataccggtatggctgcttctactatgttttttcattcagacggtcagtcctctgggggtggttctcttgaattatcaccattcagtctgtcgattttcatcggccttatgacactgattgtccaaacactgatgatttttggtgcctatatcgatcaccgaatcatgaagcaggcagataagctaaaggaaaatgaacagcggttccaatcgctcatcaaacataatatcgatggcattatcgtgttatcggtcaatcgaaaggtgctttctgcgaacgactcaggtaaacaaatcctaaaaatgtgcaattcatggattggtgacgatgtcagtcaatacgtcatgccaactgacatgtgggaagaatttatttgcgagtcaaaaaaagccatcacacgtgaagcagaactaaaagcagcagatcgcttttattattatcatgtcacttacatacctgttcatgtcaacaatacgcttgacagtatttatcttgtcttaaaagatttaacgcagcagcggattgcagaaaaagaaattcatgtcatggcacattatgatgcattaactgagcttcctaatcggcgccatgccatcaaccatttaagtgatgttctctcggctcaagaagagacaggaacatcgacagctgttctgtttcttgatttgaatcgttttaaaattattaatgatgcacttggtcataacataggggacttacttcttaaagcagctgcaaacagactgacgaaatgtttaccagacaacggctttatagcaagactaggcggagatgaatttttaatgatctttcctgacatggggcatcacacacagaaaattgaacagctttctcaaaatatcattcgtcaatttgagcgtccttttttcatccagaatcatcagctcattacatctatcagcattggaatcgctatctcacctcagaatggcaaagatggaatggaattaatgaggaaagccgatatggcgatgtatttatccaaaaaacataagcaaagccgttatgagtttttcaccgaatcaatggaaagatcaagtgaagacaggttgaaccgagagcttgagttacgggatgctattcaaagagaacagtttgtgcttcattaccagccgcaagtcagtgcaaaaacaagacagatgactggcgtagaagctcttctaagaatgaaagcaccagatgggtcgttaaaatcacctgaggcttttattgagctggcagaggaatcagggctgatcattgatattggcagatgggtcattgataccgcgtgcaggcaggctaagacgtggtatgataacgggctgaaaattcctgtggctgtcaatttatcagcgaaacaatttaattctgaagacttaattgatttgattaagctgacattaaaaaaatacgatctgacaccgtcactgcttgagcttgaagtcacagaaagtatgacaatggacaatattaagcaatcaaaacaggtgctgacgtcactgaaacacctaggcgtccgcattagtattgatgactttggtacagggcatagctccttaagctatttaaaggatttgcccattcatcgactgaaaatcgacaaatccttcattgaagatattttacatgattcgaaatctgaacagattacaggtgccattatcgcgatgggacatcaactttctctcgaggtcatagcagaaggtgttgaaacctttgcgcaggcgcagcttttatctgcgcaaggatgtgacgacctgcaaggcttttattatgcaaagccccttccagcaaacgatatcgaaaaattcattgcctatccagcgcatcagctggacacataaaaaaggtgccaatcatggcaccttttcgttctatctaaataataaatgttgactgtgaatacctgcttttttcaatagactaatcaattgttcttgttcttctcgcgagaggcctgagaaggcacgcgcaatccgcagagaatgaatcgggtaaatcttatcaagataactgcgccctttatctgttaaatgggcataaaccgaccgtttatcctttgggtcctgctctctttcaataaaaccatttcgttctaatttgtcaattacgtacgtcacattcccgctgacaagcaggagtcttgagccgatttgctgaagtttttgagcacctcttgtatacagcaattcaagaaccgcaaattcagttggattaaatccatgctctttgctgtctctaatgctgtgttctgaaacgcttttaaatgctcttgcaaataccttgtaaagtgtcattgcacgttctacttcttcttcattaaacgatagtctcatcacatatctacctcttataatatttttttaacttcaaggctttcttgcggtgcagttggagcctttcgtaaaaaatagaagtacgtttttgaaaaccctttcaaccacataagtgactccattcgtgttatgtataagatttcgatataaacttttaaaatccttcttatttttcacaaccatctcgaaaaaaaggttttttagcaaaccatcaagatacgacatagtttaacataatctgtaaagactctatgttttcttacactgcattcgtcaaatttctacaaaattcaatattgctataatattaaacaaaaaagaaccccttatgtgacatgcgcacatttcaaggggattttcacaaatcacgctctgttttgttgaaaaagaagtgatactctttttttaagtcactaattgtcatgttcttggccgcactaggactgtacacgcccaatgaacagagctgcttcgtatagtaatgtctttcctttgctaaagcttctgttaagatacgccgcaccgattatcccctcctatcaattgatctggaccaggtgcttatgaagaccttttatacaaatcattttgtacggctcttagaagagcatgtgcattctgacctgccgcctgcatgaatcgctccagtaattcatccctctttatatctaatgcgatgatttcttttgccatacagatgatccgtgtttgctccatcatatgctcctcctcctatttcaactcatcatcattatatgcatgcgcagcaatcatttcacatctgttgtaaactttccttccattgttttttcatttttatgtttttgtgttatattttctaacaaacgatgattttttttcgttgtcattctgtataatatgaagaaaaaacttgcaggggtgagtatatgacgcaggaagatgtatcatataaagataaaaaagtcatttcaatcgggattgtcagtgaattaacagggctatccgtcaggcaaatccgatattatgaggaacgcagactcatctacccccagcgctcaacaagaggcacgcgtaaatattctttttctgatgtagaacgtttaatggatatcgccaacaaacgagaagacggtgtgcaaacagcggagattttgaaagacatgaagaaaaaagaacaggcattaaaaagcggacaatataagaaaaaaatgctggaaggtcaaattaacgcacacttccggtacaaaaatcgataaacaaataaagtatcgctgactcttttaggctttttggtcatggcttcatgaaaaagagacagcttttttgctgtctccgttccatttacggcttagagctattttagttagagtatagctttaatagttcttgtgctggcaaactatttgtattgttcatgccattaacgcgttataaaattcattcactgctttatccccttatttattacttattccaacaaactttcaacattatcttaatttgagcacaatgccaaatcctattaagtgaaataagctatataagcaaggacatcagttttaatttacttttttcaggcggcgttcaataacatttcattctaagaaccaacactctatcaaataacgtttagtatattgttaagtgcagtcgatctagcgttcatccattcgttcaggaatcgaaacagttcgttcattgaccacattgcccgtgtttagcgtcgtttttggttcaatcaagagcaaatgaacttcttcttcagcaaacggctgatgttcaattccttttggaatcacaagaaactccccttcatgaagcgctatttctctatccctaaaacggatgactagatttcctttccatacaaagaacatttcatcctcgtcatcatgatgatgccaaatgaattcacccttaatttttaccattttcatgtatgagtcgttcaactctccacttattctaggattccaataatcatttatttgcgaaaatttctcttggatattaacctttgaaatcaataaattccctcctcatttacttggaaacgtctttttttatctttcttaagctaaaactccctaccttgcaaattctcctcctcatgataaacatcaagggacacaatgagcatcaacctcttatattattaagtttacttattctattggatcacgtaaaatcaaaaaatagtgtatagttcatcacaaattgtgatgcaaaaaggagcattattttggatattacatctttggagatatttaaagcagtagctattgaacaaagcattacaaaagctgccgagaaattaaattatgtgcagtcgaatgtcactgcacgaatccagcgtcttgaacaagaattaggtgttcctcttttctatcgatatcacaaaaagatatccttaacgcctgcagggcgagaactgctgccatatgcaaacaaattactctacaattttgaagaagcgatagaggccgtaaagctttcctctactccgcgaggaactttgcacattggatctatagagtctaccgcttcgacaagattgcccagcattttcgcagcatatcacaagacattttcacaagtagaattaagcatgtatatggcacctactgtagatcaggttcatgctattctcaactacaaggtagacggtgcattggttgatgggcccattcttcatcccgacattattgaatatccggtattagaagaatcccttgttctcattacaagctactctgaggaggaattccaggtagaatcaattttacatgaaccattgctttcgtcatttgcgcattgcatctatttggggcgttggcaacgatggttagagagcaatggctttgctccgatgaaggtaatggaatatggcactttagagggcgtgcttaaatgcgttgaaaacgggctaggggttaccgtattaccaaaatctatggttgaatctcggatgcaaggcagatttacctgtcatcctttaccggaaccacatagaatcgtgcccactgtgtttataaggcgtcgcgattcgtacatgactagtgccctctcacggtttatggaattattgggcataactcatatatgatcgggtcatttatggtaaaaaagaggatagatagagcgacattcttccagctcttctatccttttcaataaaatcattttagcattcattgagaggaagcgtcagttccttcaacgagccctacaaagtcaatccgtacaccgcctttttcaggatcttctatgacccgcatggccagcgcctttttctcccctgttttttcatcttcgtaattcgcatgaaagacatgaatgctggcttcttccaattgaaaatcatcataagaaagtgtctctatgccccattcttttttcatttttagaatgtcattcgaacttgggacagcgccttcaacatagatattttctatttttcgtttatttccttcgctaatagcttcaatcatatgctctgctgccaccagtcttctgtctttcccctcgtcttctcttgaacatgcacctagcaaaacaatgcacattaaaatgaataaaaacttcttcatttttctctcccaccttctccttaaaatgtaaaggatggaagcgctatatgcaatctttattcaaaaaagactgtaaaacgtcacgttttacagtcttcatgctacatcagtgtatgaaggaatgctgttgcaattccaaaatagatcagtaaggataaaatatcattcaatgttgtgatcagcggcccagatgcaatggccgggtccacatttaatctgtgtaaaataatcggcacgaccgtacctgccattgtcccaataatcagtgttgcaagcagcgaagaaccgacaacaaaacctaaaatcatattgccctgccacaccattgcgacaactgtaataataatggaacaaacaatcccaatgtaaatactcgttctcagctctctaaaaataaggcgcataatggtttttttcgttaattcttcttttgagagccctctaatgacgacggcaagagactgtgtccctgtattacctgtcatcccggcaatcatcggcatgaaaaacgctaaagcaacaacttgctgaagggtatcttcaaaataatttaaaatactgcctgaaatcagcccaatgaacaagagcaaaatgagccacggaagacggcggtatgccgccacaaatgccggtgtgtcgaacgtgatatctttaccagaggcagcaaacttttcatagtcttcgcctgcctcttgaatcacaacatcaatgatatcatcaactgtaacaattccgactaggacattgttctcttccacaacaggaatcgcaaggaaatcatatcgttcaatcagctttgcgatttcctcctgatcctgaaaggctccaacggcaatgactcttgtaaacatgagatcctgtaccttttcatccggttcacctaaaatgagatcccggtatgagagaacgcctacaagctgtttttgatcattaatcacatataaatagttgattgattccgcgatttcagcaaagcttttcagcttcacaactgcatcctgtactgtaaaatgctgaggaatccaaacgtaacggttggtcatgatccgtcccgctgtctcagcagggtaattcataagaagctggacggccttggattcctctgcttccatgttagataatagctgatcctttagctcatcctccatctcatcaaacaagttggctagatcatcgttatccattttgtttgtgacgaaggtcgctttgtctttccctactttttcaagaacgatttcttgatattccctctccagctcacccatcatttctgtcacgtcatcgactggtaaaaagctgaggaagcggctgcggtgtttctctggaagttctttaaataagtaggccatatcatatggctgaagttcttccataatgtttttaaattcttttcgttttccatctcttagtaaaataatgatgcgtaaaatgagttcatcgtacgttatattttgtatcatcgctgttacctccccaaagtcaggagatacccgaatcccttagaatgtgcgggggtcaggatctcctctatctgatgtctcaatctgatcttttgacatattctctatgtgtctcgaatcgggatgatccatccccacacctccttttcccataaaaaaacaccttcaaccgaatgaaggcgctttgtaagcatgacaaataaacacttgctccttcaatcgtagagctttagcactgtatggcataggaaaaatccagctgcattaaaaatcaccttatgtcgatgatttctgttgacccattggcgtctttggacatttttgggcagcagcgtatctccatacaggagcctcacctaacgaagtctcatattgttgacacactgagattacagaaaaagcgcagtgatgtcaataagcaagatgccaagttcctttatgtattcgcttacatttcaaaaaaagagcgatagacaaagtagaccatcgccctttcatgtctttattcctcttctggctgattcatatcctcttgggagaggagatgaaaggaatcatgcaaaaacaaagcatatccttctccgtcaggatgcggaacatattccgcatggtccattgtttgctcttcttcttttttcttcatattctctcgcctcctttcccgtagtttgtcccaatgcaaaaaccttacacatgaaagtgtaaggtttcgtgatggcttaatcatcccattcttgctttaggattttgcctgttttagcggaaatctcaaaatcaacttcctcgccttttggtgtggtgatttcgacttcatataagtacacaccattttctttatctaaatcagaatctgtgactgttccttttacttttgcaagggcaatttgttcagcctgctttttagtaattttcacattctgtttcttttctttgactggatcgttcagcgcttttcctgttttggcatcgacatatactttatattcaaaaccgccttttttaatctcaacctcatacacccattttccttttttacgctcaagatccacatcgtccacataccctttcaccacttttagggcagctttttctgcttgtttcttagagacaaacgaagatttcttttgcaccacttgctccgcgtgtgctgtttgatttgtattttgcgcttgaagtgtgaaaccacctgcgacaagagttcctgttaatgctgtagctactagtacttttttcatcatattcatatcctcctctatttgatttctcctttatcttaaagaaacaagatgataaaggaaggaaagaaacatgagaaaatcatgagaaaaggattagttttcgtacgtaattccttcaatatctcctgtatatgcgtttacaagtacctctgcctcccgcccatcaggcaaatccagctccacctcaaatacgagcataccgctaaatgtttcaagatcagcatcatccactgtccctccgacttcttttactgcaattcggatggcttcttcgaccgtgatttttgtcattttcttttctttagaggtcgggtttttcttttctgcttcaagcactttaaacgtttgcttgtcaacatcgacttgatataattctttttttgattggattgaaaagatataacgatcggacttttctttcttttgaatgaccgtaccgctcacctttttaacagccgcttcttctgcttgaagctcagcatttttttcatttggtttttgatagctctttatttgtctaatctctttcatttgaccgcttgcggaagatgcaatgatttgataaatgccatttgcattttccagcgtcaatgtatagtcctgtttatgattgattaaatcaatctgtgtaatgtttccattgtagtcttttgcaatcatttttttgatttctgcttcacttaatattttttgatcaatggtttgaatcatgagcattgcaaaggccgcaagaacgacgagacatcctgcgagcgcaagcaccattttcgtttttctagacatgcagcgcctccttcctatttcctattttataaggaggaaatgagaaattgatgagaaaagacccatttattttgagaaaagaatggtcatggttgtccctttgccgattcggctgtctaccttcagctcagctccatgctcttctgcaatttgcttcgcaattgaaagaccaagacctgttccgccggtctcactgtttcttgcttcatctacacggaaaaagcggtcaaagatttttgggagatcctcttcttttatgccaatcccatggtcaatgactgaaataaacggcttctctcctctccatccgcaggtcacatcaactggctctgtactatatttgaccgcattatcaatcaagatggtcaaaagctgtttgattttctcttcgtctccttccgcaataagcggctgatctgtttgcacacgagattgaatcgttcgattagtggccacttcaagtgtatggcaaagctgcttgcacaaatgaccaagatcaactggcttcatatccacatatagcggctgaccatttttcgccagtgtcagcaattgatctgtcagtcttttcatttttttcgcttcatcatgtatcgcttgggaggattcttctataacctctggacgtgtttgcccccagcgcttgagtaaattgctgtagctcataatgaccgtaatcggcgtcttcaactcgtgtgaggcatcatgcagaaattgctgctctttttcataatgcttctcgaggatttctgacatttcattaaaggtttggcccatttgatacaattcatccttagaatcgcctgttaattcgattcgtttaaacgccttctccctcatactcgccttcatggtactcgtcattcgactaatcggccggacgatttgttttgttaaaatatggcctgcaaaataagaaagcacaataattaaaacacccgcagcaactaaaatcatttttaataacgctaagttctcttccgtattttcgatttcttcatatacttggagcgacacaatctcgccatttgtccaaataaccggaatcgcagcgaacgcaaccatatgcttgttgtattctttgatttctgctgtctgcccagattcatatgtaaaaggcagtgaactaaacgttgactcctttgtgacagtcagctttgattcacccgtttctgtcacgacacggatcatgccattttggggcaggtaggctttcagcagctctgatgatggaagaccttcttcttctgatttttttaaagcaatggcgatattttcagccacctcagacagccgggacatatctttttgcgtcaaggtgattgaaaaaataaaataaatggctgtatggaataagagcaccattaaaaacaatgacaacgacgtataaagctggatcttattttttaatctcattctttatcctttcatcacataacccacacctctcactgtgtgaatcagctgtttttcgaatgggtaatcgacttttttccttaaataacgaatatagacatccaccacgttcgtatcaccgaaataatcaaaaccccaaacagctgttaaaagctgatctcttgtgagcacttgctgctgatgcttcagcaggtggacaagcaggtcatattctctcggcgtgagttcaagcatttggcctgctctttgtatgtctcttgttttctcgttgacagtcaaatctgctatgctgagctctgtctccttctcttcttgctcgtttatattcaatctgagttgcgcacgaattcgcgctaataattcttctatgtcaaaaggctttgtaatataatcattcgctccaagatcaagtccgcttaccttatcaggcacactatctcttgctgtaatcaacataataggtgtcgctgtatttgtctttctaactcttctcagcacctcaagaccgcttaattccggcagcatgacgtcaagcagcaccagatcgaagctttcttcttcaagagcctgtagtccatccattcctgtctctttgaccgtcacctcatacccttcatactcaagctctagtgacagcacccttgcaattttcttttcatcttcaactacgagtatcttccctttgttcatctctatctctcctatctaaaaggcaagcttgtctttccattattatatgttgccttttgcatttggaacagacacaatcttcacgtctatttttttatgaaggaaacatttatttttcaacaaaaacattacacatccttttcacatcgcatttattgcttgatctcattgttatgtagtttgcctcttttagtccttttcacccattttcctctaaacaggtgcaagctcactatgcagcatttccctctttttcatatgatatcaagagttttcctcaaaagatgagttctttcgtcaagatgtgagaagaactgcacttttgataatagattgattatttgaaaaattattacaattgaccctttccgatcaaaagtttcttttatacaataacattacgcagcctgaatctactttgaaaacaaaataaggagggctttcttatgaaaggtgaaattcgcttaattccgtatgaagtaaaagccaatgtgatggaagcgaaagagacgccggaaagtattcaggagattaaagcacccgaactttggtcaagtggcttcaaaggaaaaggcataaccattgctgtccttgatacaggttgcgacacggagcatcccgacttaaaagatcagattatcggaggcaaaaactttaccgatgatgacaacggagatgctgaaaatgtgaaagactataacggacatggtacccatgtagcaggaacgattgctgctacagatcaaaatggtggaattttaggggttgcccctgaagcaaagctgctgatcgtgaaagttcttggcggcgaaaatggcagcgggaaatatgaatggatcattaacgggattaactatgccgctgagcagaaggtggatattatttctatgtctctcggtggtccaagcaatgagcccgccttacaggaagccattcaaaacgcggtaaaaagcggagtacttgttgtgtgcgcagcaggaaatgaaggggacggagacgagcgtacggaagagttctcctacccagcagcatacaatgaagtcattgccgtcggctctgtctcccttgcaagagaatcctctgaattctccaacgccaataaagaaatcgacctcgtcgctccaggagaagacattttatccactctccctaaccataaatacggcagactcacaggcacctcaatggccgccccacacgtaagcggtgcactagccattataaaaaatgccgaggaagaagcgttccagcgcaagctgtcagagcctgaggtctatgctcagcttgtcagaagaaccctgccactgaagcagtcgaaagccctcgttgggaatggatttttatatttaactgcacctgatgtgcttttagaaaagacattggaagcagatcttttatctctataacttgaatagaggtcctgagaatagatcgaattttctcaggatttttttaattaaaattattcaaaatttactttgacgaaatgaagtggacgttatataatcgaacacaataaattcatagtttgagagtcggtaattcgaatcacacatcgaattttaattgggaagaccggtgaaaatccggcgcggtcccgccactgtgagtgaggagagcttttcttatgaatccactgtcataaggacgggaaggatgaaaagcttgcagattcaccagccaggataccagccgctctatcacatcaaaccccctacgattgataggagatgtcggaaaaaagcgtcagttctgctcacgccttatttcgcacacacattttgtctttttaaaccagacatttgccctcatcaatcttcaccatgagtgtaagtgtctttttatatttagaggaggaattggaattgacaattgttaaaacaagtaatctaggttttccgcgaattggtttaaacagagaatggaaaaaagcacttgagtcttattggaaaggtcaaacagaccgcgaaaccctcttaagcacacttgatgaacaatttttagctgccattaaaacgcaaattgatcaacaaattgatgttgttccttctggagactttaccttctacgatcacgtgctcgatactgctgttatgttcaattggattccagagcgcttccgcagcttaaaagacccgctagatacatactttgcgatggcaagaggaacaaaagatgctgtctcaagtgaaatgacaaaatggtttaatacaaactatcactacatcgttccagaatacgaaaaaagcaccgaattcaaactcacacataacaaaccgcttgaagcttacgaaaaggtgaaaaaggcgtttggtgttgaaacaaaacctgttgtacttggtctttatacatttgtctcactttctaaaggctatgaaccaaatgaagtaaaagagattcagcagcgtctcatcccactttacactcagcttttaaaagaacttgaagaagccggcgtcaaatgggtacaaattgatgaaccagcacttgtcacagcttcatatgaagacgtgaaagccgtcaaagaaatctatcaaacgatcaaagaagccgtacctgccttaaatattcttcttcaaacatactttgattcagtagatgcgtatgaagagctagtcacatatcctgttgaagccatcggtcttgattttgtccatgatcaagggcgcaatcttgatcaagtgaaaaagcacggcttcccgaaagacaaaattttagcagcaggcatcattgatggaagaaatatttggaaatcagatcttggcgaaagattgtcattcgtttctgaggttattgctgacgctcagccgaaggaagtatggctgcagccatcaagcagtttgctgcatgtacccgttgcaaaacacccaagcgaacagcttgaagaaaaactattaaacggactgtcttatgctactgaaaagctggctgaattaacaacattaaaagaaggcttaacaaaaggcgccgcagcgattgaagccgccatcaatgaagccaaacaagcacttcttactttaaaagaatttgcaaaaggaaccaatgcggatttcacaaaagaacgcaacaatctttcatcgaaagactttaaacgtccagttgcctttgaagagcgccttcgtatccaaaacgaatctcttgaactgccgctcttgccaacaacaaccattggcagcttcccgcagtctgctgaagtgcgaagtgctcgtcaaaaatggcgtaaaaatgaatggacagatgcagaatatgatgaatttattaaggaagaaacacaaagatggattgatattcaggaggaaatcggtctggacgttctcgtacatggagaatttgaacgtacagacatggttgaatactttggtgaaaaactagccggatttgcctttacgaaatttgcttgggtacaatcctacggatcacgctgcgtgaagccgccaattatttatggagatgttgagtttacagcgccaatgaccgtgaaagagacggtttacgcacaaagcttaacgaagaaaaaggtcaaaggaatgctgacaggtcctgtcacgatcttaaactggtctttcccaagaacagatatctcccgaaaggacattgccttccaaatcgctttcgcattacgtaaagaggtggaagcgttggaagaagcaggaattcaagtcattcaagtggatgaacctgcactaagagaaggtcttccgctcaaagaaagtgattgggcagactatttaaactgggcagcagagtcattccgtctatcaacatcatctgttcaaaatgaaacgcaaattcatacacatatgtgctacagtaacttcgaggatattgtcgatacaatcgaagaccttgatgccgatgtgatcacaattgaacattcacgcagtcatggcggattcctcgattatttagagaaacatccgtatttgaaaggtctcggacttggtgtatatgacatccatagcccgcgcgttccatctgtcgaagaaatgagtcaaatcattgatgatgcattgaacgtatgcccaacagatcgcttctgggtgaatcctgactgcggactaaaaacgagacaagagcctgaaaccattgctgctttgaaaaacatggtgacggcggctgaagtcgctcgtaaaaagctgacgcagcatgcataactgatttcctctcccctgctatcatggcgggggattttttatgcgtaaattgtcctgattgaccatctactagaaggtttccttttctagcatgattcgtttatactagagaagtcagacgaacaaagggaggaagacaatgaatcacgaagattttttacaacgcgcaattgaccttgcagtagaaggagtcaatagtggtactggcggtccttttggagcagtcattgtcaaggatggacagattattgccgagggaagcaacaatgtgacaacaacgaatgatccaaccgcacatgctgaggtcacagccattcgaaaggcgtgccaaacgctgaatacataccaattagaagattgtattttatatacaagctgtgagccttgtccgatgtgccttggcgctatttactgggctagaccaaaagcggtctattttgctgctggacatcaggatgcggcagtttctggttttgatgactcatttatttatgaagaaatcaataaagattacgaatcaagaaatattccattttatcagctgacacttcaaaaaacccttgcaccatttgaagcatgggcaacatacgaacaaaagaaagaatattaaaaaaagacacctgctcatgagcaggtgtttctttttttcagcgtgatagagaacctttttattcagccacttcaagctctacttcgatgttccctcttgttgcttttgaatatggacagaattcatgcgcagcctcgactagctctttcgctttgtcatggtcaaggccttttgcagatacaatcagcttgacaccaagcttaaatccgccatcactttcatcttttaaaagactgacatgtccctcgacttctgattcaatgtcgaccccttgctttttcgctacttgttcaagtgcccctccgaaacaagctgcatagcccgctgcaaataattgctctggattcgtaccagtttctccgtctttctttgcattaggcatgacaatgttatgatccagcacaccatcttctgagcgaacgtgtccagctcttccgtgttgtgcctttacttttgctgtgaataatggtttcatctttatctcctcctttatctatttattcctttcacgttctatccatttctcaaacatttatcgcacattaaataatttttcgtttttgggctgtatttattttaaaaaagaagaaaatcttatacaataataagtatgacaaaaaatagttggtgactgacatgacaaatgaattcgagcacatgaagctggaaaatcagctttgtttcttgttatatgcaagttcaagagagatgacgaagcagtataaaccgttattagaagagttagacattacgtacccgcaatatttggcactgcttttattgtgggagcatgggacattaaatgtgaaaacgatgggagagcttttatatttagactccggtacactcacacctatgctgaaacggatggagcaaaacggactcatcatccgcgagcgctcgaaagaggatgaacgttctgtgcaaattcgtttaacggaatatggagggcagctaaaagagaaggctactgcaattccatttcagatgctgtctgggacaggcagatcggaagaagagttaaaaacgctacgtgcctctttacatgagcttttgcaaaaattaacacaatcaaaaggctgagggattattccctcagccttttatgatatcaattattgtgcgacagctactaattccacttcgatatttccttgagttgcttttgaatatgggcatacgccgtgtgctttatgaacaagctcatctaatgctgattgctcgattccagttccttttacttctaacttaacgcctagtttgaagccgccatctgaactgtcttttactaaactcacatgtgctgttacttcgctttcaaaacggatacgctcttgtcttgcgaccatttgaagggctgaatcaaaacatgcagagtagcctgctgcaaataattgctctggatttgttgctttttctatttttttcgctcttggtgttccaggcattgctacatcatgctcaagcactccatcacttgaaacaacctttccttctcttcctccgacagctgataccgttgcagtaaataaaacttctgacatgtatataaccctctttctctccaataatattttctacaattgaattgtacacaatttaaatttaagagtcaacgaatacacactctttttttaagatttccttcttgcctctcttttatgtagacagtaaaaaaagccctttaataagggcttttagatgatgtcatgctgcgcatgtggttgttgtagcgtatggtttctgttatccgggtcggcatttgctgctgccagccataacgccaagatggtgatgcttgtacagacgactgcccattttttaaaattcatataaacaatcccctctctgaatatagattcgagcatgttctgcttctccgtagaacgtggaagatttttcataatcttccatttcattataatactttgcggtgtctaatgccagctcctctatatctggatatgcataggcagactctaaaaaatgaaaaattcgtttaatatgctccgcatcttgctttaaatacaatgcttctaaaaatatcgtcttttgaatatgaatgtcatcctgaagtgcttctgctcgcttcatacattcttctctgtagtgtaaggcttcttcgtgtttaccttgtttgtataatatctgagcggctgtataaagagggtctatggatcgacgaaggtgatcagattgattttggtcaaataacgagatggattctttcattagttcgagtgcgcggtcaagatctcccattcggtaataactgttgcccatattaaacaaagaggaagcaataaaacgcacattttgaaagtctcttgatctcgcaagtgctctctcgagatgtggtaatgccttttcatgtcttctcatatcatcataattacctgccacaataaattcgcattggatcgtgcgaagcgcatatagctcatgctgaatataaacatccagcgccagtttggcatgatgcatcgagatatgtgtttgtttcatgtgataatatatttctgacattttaaaatgaaattccgcacgttcaatatcatctgacacaaaagaaagcttgtgctctgccttttgataagacgagatggcagcaatatactgcctacggccaaattcatacatgcctctgaaaaaatgatagtagtattcaagcatgcctgtgacatgtgtttgatgctcatctatttctttcgaaagctcggaaaagttggcgcgaagctttccttcctttaatggctttaaataatcgagcatgacctcatgtctgaattccattaaagaaaaatagagaagcaaattctgatcttcttccattgaatcaagagaggtgcgaatttcctgctttagttgttctgcttgttctgaatcaaatctgcggattaattcataccacttgttgattttcactccaatatccgaagagggaatgattttcgccatacgttgccttctccaatcttttcaaaatataaaacattaccatattttatcatacttgaccgaagaaatacaaaaatgaaaggaaaaagagagcctattgtcacaagactctcttttgaattcgttattctcttatttgtccttgaccgcgaatgacaaacttttcagaggttaaggcaggcagacccataggtcctcttgcatgcaatttttgtgtgctaatccctatttctgctccgtagccaaattcaaagccatctgtgaaccgagtagaggcattatgatagacagcggcagcgtcgacagctgttaagaaaagtgacgcatttcgatcattttccgtaatgatcgcttcagagtgcttggaactatacgtttgtatatgctgaatcgcttcttctatgttggctacggttttaatactgacaatcggcgctaaaaactctgtttcatagtcctctgtgctcgctaatgaagcacttggcgcaagggcacatacagcttcatcgccccgtatttctaccccatttgcatgaagggcttcaaataacgaagcgccatatgtttttgcccatgtttcatgaatgacaatgctctcgatcgcgttgcaaacagatggcctttgggttttagcattcagcacaatctgctcagccatttcgtttttcgctgtttcatcaatgtagatatgacagttccctgcccctgtctcaagcactggcacggtagactctctcacgacaagatcaattaaatttttcccgccgcgcggaataagaacatccaaatattcatttaaagtgaacagcgttttcgccgtttcacggcctgtatcttcaatcaattgcacactgtctactggaatttccgttgtgtgaagcgcttcatggatcaccttcacaatcgctttattactatgaatggcagaggagctcccgcgaagaataacagcattcccagttttcaaacaaagggtggcagcatctacagtcacgtttggtcttgcttcataaatcattccaaccgttccaagaggtacacgcaccttttcaatgaacaaaccgttttcttttcgaatagtttctaatgtttcaccaattgggtcttttaggtgaatgagttgaagggtcgcgtctgcgatggcttctattctctcttctgtgagtgtaatccggtcaataacagaaggcgtgaactgcttttccccggcagcctgcacatcttttttattctcatcgagtaaataagcggaagatgctttaagtgccgttgcgatggcatgtaaagctgcatttttttgttccgtcgtttttaggagcagctgatctttggctacacttgctttttttgctttttcaagaacttcattcatcgtattccctcctcagttttgtacatgctgtacccagtgatctctgtgtatgacttcaggcttctcatttgaaagctcatcacttcgcagtcctttaataccgagaagctcatcagatgcgtacaaggtttgtcctttacctactagcccattcggaccgacgacttcaacgacctctcctttagaaaagtcaccagcgacatcaataactccagctggaagaagacttctcccatgatgcaaaatcgccgcttctgctcctgcatctatcatgattttcccagaaacgggtgaatggaattgaatccactgacggcggttgttgatcgctgataagtcctgttctccgatatacgttccgtctccttgacccgcaagaatatgaaacagcttatcttcaccagtacctgtaccaatgaagactttcacgcctagtgaaagtgccgtttgtgcagcagacagctttgatttcatcccgcctgttcccacttttgagcctgtactcttcgcatatgaaaacaattcttctgaaatgtgtgttagtacatcaaaacgcttcgcatcaggatgctcatttggatttgcattataaattccgttaatgtctgttaagatgatcaattggtctgcatgaattaaaccgctgacaagagctgacagcatgtcattatccccaaaagtaagctcctcaatggagacagaatcattttcattaatgatcggtaaaatttttctttccagcagctccatcatcgttgcgtaagcatttcgatatcttgttcgatctgaaaagtcattacgggttaaaagcatttgtgcaggtgtcatgtgaaactgtgaaaatagttctgtatatttctgcattaacaagccttgaccaacggcggctgctgcctgttttccctttaaggtcacaggtcttgatggataccctaagctgccaaaccctgctgccacggctcctgatgaaattaaaataatttcatgcccagcctctttcagctttgctatcgctttcacatgatcctgcattttttgttcatcaatggttcctttttgctctgttaatgaactgctgccaattttgatgacgatcctttgctttttcattattgattccctccgctatacctttaggcacaaaaaaatccctttttctccttatgtaaaggacgaaaagggattttccgtggtaccaccttcattgaataagcatacttctagcttattccactcaactcctgtaacgccaggcacgcgcttagatttttcctctaaggctcaaagggcaggttcagcagctgtctgcggcaaatgtttcagcatgtcatttgctctctttacgcatcagttcctgcttactattccttttcaacgctcgttaatttttttatattatcaccaattgcaaaggaaaagtcaagcggtcaattaaatacaatcgttttattctcatgcacaataattcgatcttctagatgccatttgacggcacgtgcaagcacactccgctcaattgttcgaccaatattttttagagcttccgcatcatcccggtgatctacacgctctatatcctgttcaatgatcggtccttcgtctaaatcattggttacataatgagaagttgcgccaattaatttgacacctcgctcatatgcacgcttatatggattcgcaccgataaacgctggcaggaaggaatgatgaatattaatgattttgttcgggtgctgttctataaaagcaggtgttaaaatttgcatgtatctagcaagcacaatggcatcaatatcatactcttctaataatgcaagctgctgtttttccgcttctttgcgaatgtctttgttcgccttcacaaaatggaacgggattccaagcgcttctactgtatcttttgccgtttcatgattgctgatcacgaccgcaatttcagccatcaaattgccgctttgccattcccatagcagctcatgtaaacaatgaagctcttttgacacaaagattgccagctttttaagctcacttgcacgcgacatgctccacgtcatttgaaaagatgctgcaattggctcaaactgctgcttcagctgatccatatttgccgagatatctttccaatcaaattcaattcttaaaaagaaccggccgctttcatggtctgttgtgtattggctggattcaatgatatttgctccgttctcaaataaaaaggaagaaacagctgatacaattccaggctgatccgggcagctgacaagcaatcttcctttttgctcatgcttttgtctgtgtaattcaagtttctctgttatcaaagttctcatgtatcatgacctcatttacgttttcattctaatgaaatattatactggactggaaagagaaaaagcaatgtagagccccattttttattgaatattcattcaattctgcccctagcgtgatataatgtgaatagaccttttagcataaaaggagtgatggagatgaaaagtatgactttgtttggtaaagtgagcttttggatcggcatcgtttgtctgatcacaggtatttccctttttatagccggcgaaagactcgttccttttctcacatttggtgtgtgttttctacttgtgagccagctttaccgcaaaaatgaaaacgattccaatcatcattcgatgtaacaaaaggctggcatctatctgccagccttttcttattcaatcattttcaatcctactgccgcagataaaatcaatgcgatgaagaaaatacgttttgcatctttcgactctccgtaaaagagcataccgaccatggcgcctccagcagctccgattccagtccaaatggcgtacgccgttcccatcggaatcgtgttcatcgcaagagacagcatcagaaaggacatcgaaaagccagccgcaatgaataaaatccatttgacatgcttgtctttttggaattggttcatcatggtcacacaaagcatttctaagatgcctgctccaataagtaaaagccagctcatgattcagcctctcccttcttttcacctgttgtcagcttcagtcctaatacaccgcacaaaagcatgacaatcaaaagcagtttgacaagctgaaccggctcaccaagcaccatgcctatgacgacggtacctgctgtaccaagcccagtaaaaacagcataaagtgtgccaactggcagtacatttgttgctttcatgagtaaataaaagctcacgataatacaaacgatggttgcgccccattctatgagcgagtgggcatatttcagccccatcacccagccgacttcaaagatggccgcgataaagacatttccccatttcatctgatcttctcctttctgaacgattccaaccaacaaaaaaagcctggaaatcgatcgtttgatcaaatctcccgggcttttatccctccgtgtccatatggcctcttctaaagaccctatgtgttttctctcggaccagactgcaccagcgcacggaaccctagaaaaccaattcatgataaacagatctgacttagagcagattctgtattaaaaatcttaccacaccccaatatgccggtctaccagtttgctctccctcttcaaatatacttgttcatttttcgaaagaaatgatttcggaccggcgtatactaagtgttagaaacagatcaactgataaagaagatctgcgggatatttccgtgctgccaaccgaagggaaatgagcgtatatgacaatccatttattttttattactttgacgatcaagcgtaaatacaaggacatggagaccgttctttacgaacaagaagtcgaaacaatttatgaagaaatgaaacagaaacaactaaagtatatgaactaaaacagaaaaaatggaagaaggaccaagttagaaacgcccagacattaaaggaacggtcatatcgctggtataatgaactcagattgatgagatgaacgttccactttaggatgctgcatttacagattatccgttgtatcggcctaaacaatgctgaaaaacattttatagaaaaccaagaggtggatcatatgatgataaccaacgaacagaaacatgaattttatcaagcactggttgacaagaatccgcaatatgacggcacgtttttcgccggcatcaagaccaccggtatcttctgccatgccacatgtaccgctagaaaaccaaaatatgagaactgtgagtttttctttacagcagaggaagcactgctagcaggatatcgtccgtgcaagcgctgcactccattaacatatccgaacagcattccagaagaagtcaaaacactcgtttcagcagttgaaacacatcctgaaaaacgctggaaagaagaggactttcgcgagctaggaattcactctgcaacggctaggcggaaattcaaagaaatctacggcatgacctttgttcaatatgcgagatcacgccgaatggggcttgcctttaaagaaattatgaatggaaaaaaagtgattgatcagcaggtcgcattgggctatgattcttcaagtgccttcaatgatgcctttacgaaaatcatggggaatccccctaaaaagacgcaaaccaaaattcttcacgctaattttatttctacaccgattggacgaatgatcagcgtgacagatgcgacgcatgtgtatttactggaatttatggacaggcggggactagaaaaggaaattgagaacatgagaaaaaagcatcatgcgcgtattttagttggggaaacaaacgtccaccagcaattaacaaaggaattgaccttatatttcgagaaaaaactgacgcagtttacagtaccactttccatgcatggcaccccttttcaaatgaaggtgtgggatctgctcacacgtattccttcaggcgaaactagttcttaccgagatcttgctgtgatgctgggcgatccgcatttggtccgggcggtagggaatgcaaatggtgccaatcagttggcgatcatcattccatgccaccgcgtcattcaaacaagtggtgagctcggcggctacggcggcgggatagaacgtaagaaatatttacttcaactagaacagcggatataaaaaaacggctctgcttattttgtaagcgagccgttttcttcgttgcgggtgatgctgtaaacatcaatgatttggtcccattttgaaatggttttttcttttttcatgcccatttttaaagcgacctttaccgatgcttcattgtccgggcggattaagcttaccattcgtctgactttcatttcttcaaagccataggtgaggcagccttttgcggcttcagcagcatagccattcccccacgctgctttcttaagcatatagccgatttcaagttctgtttgtccttcaatgttttgcagaacaattccgctttgtccaagtggttcattcgtttctttgtcttcaatgatccagagagaagtatgatagatgcggtcattcttttgattccatgcaatccactctttcgtctgctgctcatccttcaaagatggataatacttcattacttcttcatcttggaacaacatgtcatataaaaacgaggcatcatgttcattcatcgttctcagtctaaggcgctctgtttcaagcactgtgcgtgtttgaagtttcatttatgaacctcccacttactgattaaaaagatcaccgaacagtccatttgaatctggggcaaagtaatggattcccgcaccggttaaactagctgccagcgccgtccacatcattaaactgactgtcatccacaccgcaacttgctttctcttcgtcccgaaactcatgcacataaacgccgctaaatgactgccaatgataaaaggaccgactatcgctaatcccgggagaccataacgttcccaaatttttctcgcccgctgctgctttttttctcctttttcattgcttttgtcctcttttctctttaaccgccatgctttaaagcggtctacgaaaacaatgagcaggaaaacggtaaaaaaattgccgatgaacccaataaccgctgccggtacaggatgcatgccacttaaaatggccagcggaacgacccctaccacctcaaaaaaaggcaaagcagccaatacaaaaacaagtacatatccccataaaatatccaaacacagaaccccttttcatttttgtcctcttcccattgtaatgaaaaacacgttaccatttctacatttttttagaaaaagaaaagcacatcggatgggatgtgccctgtttttttacatcgtattttcatttttcttattcgttcggcgtaaaacaatgagcacaagcccgactaagatcacaatagatagtagactttgcaagagaagcacgcttggtgatgtccagccaatccattcgaatatgagctgcggtccgaaaaagatgattggaatcagtgaaatgagattcgctttcatgattgcattaaaaacaatgatacataacagcataagcaggatgacgccccatctttgacctgaagtcagtacaagtaatggtttgccgagtttttgatccaatagtttgattgtgaccattgaagtcaactgaaagattcctaagatccagaaataaagaaatgcccggcctcctgtttgaaaggaagacgctctaaacatgacaatgatcatgatgacattggctactaaaacgagcggataaccaatcaatgcataccaagaataggataagctttgactgatcgcatctgataaaatcatataaaagagtgaaccaattaagaaggcactgacaaaaggaatccagtctttatggtttcctgacagctcttttgcaagttcatcagcatagccccgcggatctccgccaaacaaagcctcccctgttttaccgtctttttcagcctcaaccgcatgtgtcgtcagttcatccatcagctcatcaatttcgtcctgattttttccctttgatatgagatagagtttcagctctagtagaacgtgtcttgtttcttttgataccataatctcacttccctttttgtagtaaacagtttacattttttgaaagctcactccagcgagtaataaactctatgagcgctttttctccagcttgtgtgagcgtatagtatttccttttcggtccgcttgctgatgcttttgtgacagtggtcacgagctgttccttttgcatacgcagcaggatcggatagatacttccttcactaatttgatcaaacccgtaatgcgcgagcttcttcgtcatttcatatccataaatctcaccctctgaaataatcgacagcaggcagccttctaaaattccttttagcatttgtgtggatgttgtcatctttgttcctccgattccagtaccttgcatcacaagatagcatcatcttaccacacactatcttgccatgcaagataccatcctagaaaaaaatcaccgcttaaagggtgatttttacgcccaaggcttatctgtcccaagtgcgtcagccaaagctttactatgctttcggcggctctttctttcctctgcccgctgcttcgctgtttgatgcagcatgatttcttcctctgtttccggcatgacttgcgggactcgttttggcttcccattttcatctagcgagacaaatgtcagaaatgaagtcgctgcgagtctgcgctctccagacatcaagttttctttcataactttaacgaacacttccatggaagacgtgccaacccatgtcacataggattccaagcatactgactctttttgtccaattggctctaaaaagtcaacagaatccatagaagccgtgaccgtttcactgcggctgtgccttgctgccgagatggaagcaatgtcatctatataactcattaattttccgccaaacaaggtttggtgattattcgtatcgagagggaataccctgctggtttttacaactttcgattccttgcagtatttgaaattttcttctctcatcatcatagctccttcttgctgttttcgtgaatgcggaacgacttttattaaacactattcttttaggtttgtctaaactttttgctttagtctcttgtgagagattttctttcggaaatgtttcaactatgactagaacgaggaataatagaactatgaacaaacaaggaggccatttgatggattctatgagagcagaacaaatacacaaaatgccgcaatgcatgagtgaatatgacgatttacaagaagtccttttatgcagtcccatctatatggaaatcaaacagatcatcaacgaaacccaaaagcattttgcaagagaaaatatttctcaaatgaaagccattgctcagcataagcaattgatccaaatcctaaaagaccatcaagtacgccccattatgcttcctgcaaatgaccgctttcctgaacaggtctttactcgggatattgggtttacgattggacatacactctttgtttcaagcatggccgctccggttcggcaaggagaagaacaattgttaaaagagtgggcacagggaactggattgaatactgttaccctgacaaacggaacaattgaaggcggcgatgtccttgtggatcaaacacgtgtatttgttggaacgagcaaaagaacaaacacagccgctattcatgagctaaaaaaagaactgccggatcatgacatcattcccattcatcttcctcctcacattttgcatctcgattgtgtgatgaatattctgtctcatgatgagatattgatttatcctgaagcgttcaaaaaagaggatcttcacctgctcaacatgcattatcatctcattggaataagcgaacaagagcaattcacactcggaccaaacgttttatccattggacagaaaaaagtgattagtttgcctatcaatcaagaaacaaatgctgctttaaccgctcacggctacactgtcattgaagtgaatttttcagaaatcattaaatctggcggctcttttagatgctgcacattgccgattcggcgttcatccactaaaaaagccagcgtgtagaacagcttgtctacttgctggctttttatctgcctattttatttctgatcgtataaatgacaggcgacatcatgcccttcttctactgcttgtaatgttggctttttttcagcacacacatccatcgctgcaggacatcttgttcgaaacacacagccgcttggcgggttcactggacttggaatttctccttttaaaatgaaccttttgcgcttgtcctccacgtcaggatctggaatggggatcgcagacagcaatgcttgtgtataggggtgaagcggtgtttgatataacgcatcactgctggtcaattcgacgagatgacctaaatacatgacaccgattcggtcgctaatatatttgaccatcgacaggtcatgtgcaataaagagaaatgtcagtccttcctccttttgcagtttcttcagcagattcacgacctgcgcttgaacagagacatccagtgcagaaattggctcatctgccacaataaatttcggtgctaaggcgagtgctcttgcaataccgattctctgcctctgtccgccgctgaattcatgaggatagcgagtggcaaagtcatagctaagtccaacagcttccagtagttctttcaccctggcaacccttctcttttgactcccataaaggttatgaatctccattggctccagcataatatcttttacagacagccgcggatttaaggaggaatacgggtcttgaaacaccatttgaatttgccgattaaaatcaaaggattccttttgtgaaaggtgatgaaggcttttcccttcatataaggcttccccatttgtcggttcataaagacgcataagcacttttccaagtgtggatttcccgcagccagactcgccaacaagaccaaacgtttcaccttgtttcagctgaaaggagacaccgtctagcgcttttaacgtttttcctttcgatagatgaaaatgttttttgagattgtttacttgtaaaagtggttcaactgccatgacctttgctcctctcgcttggcaaataccgtcttgcacctgcccattctttttcatatgaagtgccagcaagagaaagaagttcaatttctctgccggttttaggcgaatgaagcatcataccgtcacctgcatagatccctacatggcggacagctccctttccgttgtcattggcgaaaaacaataagtcgccttgttctaaatggcttgatgcgaccggtgttccttgcactgcttggtcacttgcgtccctcggcaaaagatatccgcacgctttatacatgctgtaagcaaaccccgaacagtcatagccaaagctgctcatgccgccccataaatacgaaagaccaataaattgttttcccttgtctacaacatctttgccggtcatagaggaagtggaggaaactggctgcacatcttctttattgatttctctcgtccctgctggtgtgacaacacgaaagcaatcactcgtttcttctaaagctgcgagctctgttaaaaaactaatttccatgtccgcttgcccgttttgatagagcgtggcttttttctgacaaacgatatgagatatagctggcgcacttccttctgtcacttgctttagttggttcgcaggtatatagccaggatagccttgtggatgtttccggctggcctgctgcggaataacgactttcatccagccgtctgtctcttctaatccaatgactcgttcaccgagcagtacttgcgactggatcagattttcttcacataaagccagtttttcttcatatgtttgcttgtcaatccactctttgattttgaaggagctctgaagtaccttttgatcgatttctctcggtgactgcggcgctgtccatacattcgcaactggaacctttgattcaaatatcatcatgagactcctttcaccccttgaatgcctaatccatgatgcggcgggaaaaagatatcttttcctttgtacacgattcctccgtctaccatgtcctcttttagcatcagcggggcatcaaaatcatagcggttgatattcggctggcttgcggcgagatgagcggctgctgtaatgccgagttttgactcaatcatactgccaaccatgcactttacgccgtatgcttctgctaaagcgttgatttttaaggcttcttttatgccgcctgatttcattaattttaaattgatcaaatcacagcttctcgtttcaagcaccttgatcgcatcatgaaaactgaaaatgctttcatctgccataatgagtgtatctgttgcctccgtcacacggcgcagaccttcgatatcttcttttggcactggctgctcgactagttcgatattcagcgcctccatttttcgaatggctacgaccgcttccttccacgtccagccctgattcgcatcgagcctgatctgaatatccggtccgaccttttctcgaattcgcttgatacgctgaatatccgtgtctatatcatcttttcctaccttgatctttaatgtctgaaagccttctgctgcgtattgcttcgcatcttccgccatctcaagcggccggttcacactgaccgtataatctgtttcaagctgactgcgatatccgccaaggtattgataaagcggaagtcctgcctgcttcgctaagccatcataaatggccatgtcaaccgctgcctttgcgcttgtgttgcaagcgagcacacggttcaaacgagaaaaaatttgttcatactcggacaaggaagccccaagcaatatcggtctgatcacttcacagatggcatagtcgatgctttccagcgtttcacctgtaatcaccgctgtcgggactgcctctccgtagctgacgtcaccttgatcatatgtgatgataacaatcagagatgctgcgtcatacaccgttcgcaaagcggttttgaacggtttttttagcggtacgctcattctgcatgtacgaacatcgacgattttcatttgatcgcctctttcgctgcaacgccgggagaaatgtacagttttttccctgtcgcatctaatgcagcccgcgtgcccattggaatggcaaagttcggagaagaatggccaatccgaaagcccccaagtgcaggctttttttgcggcacaatataggtgtcccatacttgattcaatgtgagggactgatctttcttttttggttcacattgatgaaaatctccaatgatgaatccagccgcatcatccaattttcccgcagatatgaggtgctgcatcattcgatcaattttatagggctcttcatcaatatcttcaatgaacaaaagctttcccttcgtatcgatttcaaaaggtgtaccaagtgttgtcacgatgagggcaagatttcctccaacaatctcacctgaagcggtgcccggatagaaagtatgaaggggtgacaagtggtgcgcatacgtaaaggttttcggtgcgaacagctgtaaaaaggtatctttcgtataaggatggacctcctcaagtcccacatcagaggagagcattggaccatgaaacgtcacaagacccgtctgctgctggatggccgtatgtaaaaacgtaatatcactatagccccaaaagatttttggattccggcgaatcaggtcatagtcaatggcttccgcaagtctgccagtcccatatcctccgcaagcacaaataaccgctttcacttctggatcttgaaacatgcggtggagatcctccactctttcatgatcatgacctgctaaatacccgtaccggcggcccaaatacttcccttttttcacctttagcccgaggctttctaaaaaggcaatcccttttgctaatttcagctcatcaggcgggcttgctggtgcaataatccccaccgtatcccctgtttgaagtgccactggcagctggctcatgccatatcccctctttctcttcgtttctttcaatctatgggtttctgcttcataacatgaacgaataaaggaacagacgcttttatttcaaagcgtcttctgatcctcatatcactctccatctacttgtgcccatttcaaatcgatgtacccaacagggtgacggacaatccctttcacgccttctttttgtaaatggacttgattataaaaatgaatcgggatgatcggtgcttctttaatgagaagtgcctctgcatcatgaagaatgttgtttctcttttgctcatctgcttcttggcttgcctttttgatcaactgatcataggtatcgttggaccatcctgtccggttcatcgcattccctgtttgaaagctctctaggaaattgatcggatctgcatagtctgctaaaaatgaactttgtgagaattggaatttcagcgccttttgatcttctgcaaatacattggcttccatgtttgcaagcttcacatctacacctagcgcttctttcagctgctgttggatggcttcagcttttttcttgttctcaggctttgtactatatgtcaatgtgacggctggcagttttgaatagttctcttctttcagccctttttctaatagcttcgcagcttcactcttatcattcttcacaagatcaccgccagcttctctgaaatcctcgccctttgaatctagaatgcctggcgagacgaaagcacgtgctggcttctcttcattttttgtcacataatccacgatatcttgcgggttgatcgccatttgaaaagctttgcggatgttcttattttgaaaaggttccatgtttacattcagacgataaaagaacaatccagcctggtcttcaatttgtacatctttatttttcagcagattttcactttgctctgctgggacaaaggcagtatctaaatctcctgattgatacatttgatagtctgtgtttcgatcactgatcatcagccacttcacttgatccagcttaactgatttttcatcccaatacgtctcacttttttccattgtgaagctctcatcatgtttccactctgtcagcttgaacggtccatttccgacaaaggttttggcgtcttttgcccagtttgggtccttctttgcgaccagttcattgacaggaaaaaaggcagggtttgcggtcatatttaagaacgatttctgcggatatgctagtgtgaccttaagcgttttgtcatttacagcactgactttcacgtcttctttctttcctttgccgctgttaaatgcctctccgccttcaatcatgtatgctaggaacgatgcagaagagcctgttttcggatcaagaagccgcttccacgcatattcaaagtcactcgctttcactggatcaccatttgaccacttgatgccatctcttaaatggaacgtatacgtttttccatcctttgaaatctcccatttttccgccattgcaggagatggttcgtgcttttcattcagtcttgttaatccctccattaagttattgagtccttgccacgatacattattaaaaccaatcggcggatcaaacgacgtcggttcgttttcgttatttaaggttaatactttcttttcaccctctttgcttgatgatcctttccctgcttgctcattggctgtacaccctgcgagcagcatgatcgtgaacaagcatatactgatgatccatcccttttttctcatcaaaaactccccctttgtgttgaagataaaacggtttgattcgcacgctcatcttggagccagcaatgcactgtatgggtaggtgaccgctgcgtttcatgcggcatgatatgatcacataccctcatggcggcagggcagcgatctgtatacggacagccctttggcggagcaaataaatcaggcgggcttccttcaattggaatgagttcatctttcatatcaagtcttggaacggattgcagaagtccttttgtataagggtgctgcggactgtaaaaaatatctcgcctcgttccgacctccaccattttccctccgtacatgaccgccactcggtctgcgacttgggctacgacccctaaatcatgtgtgattaaaataatggtgacccctgtttttctctgaatctctttaaacagctctaatatttgtgcctgtatggtcacatccagtgcggtcgtcggttcatcagcaatcagcactttcggctcgcaaatcagtgccatcgcaatcatgagccgctgcctcattcccccgctgaactgatgagggtattgctttagcctttccttcggctgcggaatgccgaccaaatcaagcatccgaatggcggcttctttcacttcttttttcgtcagcttttgatgctcctttgccgcctccatgagctgatcgccgattgtcaaggttgggttcagtgcggtcatgggatcttggaagatcatcgaaatatcgacacctcgtatggcgcgcatttctttttcagataatgacagcaaatttcggtcttcaaaccagatttctccctgatcaacatgagcgctgtatgctggcagcagcctcatgatgctttgtgaagtcacacttttcccgcagcctgattctcctacaatggcaagggtttctttttcatatacatccacattcactccgcgtaccgctcgaactgagccgccatatgtccgaaagctgacgtgcagatcgatgatttgtagaacttttttcaaagcgccatcacctcttcatcttcggatcaagcgcatcttgcaagccatcacctaaattgttaaagcaaaacatcgtgagtgaaataaaaaacgcagggaaaaataaacgccaccaatgcccgttatctgacagcactgtcggcagtgcatcattggccatcacgccccagcttgcaaacggtgcttgaatgcctaaaccaagaaagcttaggaacgcttctgcaaatatcgcggtcggtacagttaaggtcatctgaacgataatcggccccatcgtattcggcagcaggttgcggcgaatgatacgcagactctttgcaccaaaggtttttgaggcaaggacatattcctggcttttcagctgaagaacttgacctctcacgattcttgccatgccaatccatccggtgacagtgagcgctacaataatggtgacaagccctggccccatcagaaccatcaataaaatgacaacaagtaaataaggaagaccgtagagcacctcgacgattcgcatcatgacatggtcatatctcccgcccttataaccggcaatccctccatagatcacgccgatagcaaaatcaatcagggctgccatgacgcctacaaataacgaaatacgtgccccgtaccatgtacgcgtgaacacatctcgtccaagctcatccgttccgaaccagtgagcagcggatggcggcagattttgcatcgaaagacgctgctctgtcacgctattaggtgcaagcaatgggcctaatagtgccatgataaaaagaaaaatcaataccgatagactaaacatcgcaagcttattttgcttcagtcgtctccatgtgtctgcccaatacgaaagagagggtcttttaatggcatgggcctccgttttcttttgctctctcggagaaaaccattcgtccggcacttcatgatgcggattcggttgatcctgctgcaagtgtatactcatgcctttcctcctttctgatgcagctgaatcctcggatcaagcaggcgatacgccacatcaacaatgaaaagaagtgtgattaaaataatgctgtaaaaaacagtggttcccatgatgacaggataatcacggttgttaatactctcgacaaagtattttcccatgccaggaatcgcaaatattttttcaatgacaaaacttcctgttaaaatacttgcgacaagtgtgccaagaatggtcacaacaggcaaaagcgcatttcgaagcgcatgtttgaacacaattttaaagggagaaagtccttttgctttagcagtgcgaatatagtcctgagacagcacttcaatcatgctcgatcttgttaaccgggcaataatggccatcggactaacggcaagagcaatggttggcagcaccatatgcatcggacttgtccacatcgctgtaggaaagagcttcaaattcacagcaagctgctgaattaataaagtagcaaagatgaagtttggaatggatataccgaaaacagcaatggtcatggcgatataatcaatcaagccattgtgccggagggcagccatgaccccaagcaggatgccggagatgacagcaatcaatattgagataagaccaagttctaatgagactgggaagcctctcgccaatagatcattgacactttcagaaggctttttaatggaaggaccaaaatcaaaggtaacgatggattttaaatagatgacatattgaacatacagtggttcgtctaagtgatagtagctttcgaggtttcgctggacagtttcgtttgtatttcgttcttcattgaaaggcgatcctgggatgaccttcattaaaataaacgttaacgtcgtaattgttaagatcgtggcaatcatcgcaataaaacgcttgagcaaaaagctggtcatctgccgtctccccctcgtttaacaaaatgttgtacgtgcggcaagctctgtcatgacaagcatcgcttggtaggcttctaatatattctctgcttgatacgtcaccgttgttgttccttctatgatggcagtacctggcattaaattcgcccattcagcttgtccataattggcaaattcaatcttcagcagcggctgatcaggaggcgtcagcggcttgatgtaatgaatctgtttcattgcagcttccacttgctgcgagatttgttggttgactttggcaggagtgagacatttcacagcagatcttgatatggtctcttttactgccactgttttcacaccaggcatcagcttttctgcttcaagtgctgcttgatcatctccgcaaacaagaatcaccggcacaccgtagtagcctgcaacatacgcattaaagcccatttcaccaattggatgatcatttatgtaaaaatgtctgacaccaaaaatcatactgtgggacatcacacctttcatagacgccctcgcatgatagcctaaaaaaacagcagcgtcataggattgatctaacccttgaaccattgaataaggcttgacgtcaccagatataagagatgcctcttcatgcaattcttcaatcaacaaattattcattttggaatgactgtcattgaccaagatgtcggttgcgccatgctgaagaagagcctccacacaggcattcacttcacctgtcatgatctttctgccccgttcataattgtgctgacgggcatcaacaaatgtatgatcagctagaccagtaatcccctccatatcgacagatacatagagcttcatccccatccccctttaattaaacttaaaatttgtgtatatttttctaaattttctaaaaaattatatgattacttgattgatttttcaatacaatgtctgaaaataaggaaattagactcagataatacaggtcaaaagactttgtgacaaaggatttttttaacaaataaaacaccactaactatgtctttagtggtgtttgtccgcttcgttaatctgtgattttagctgttcatatttcttcatggtttgtgtaaatagatcatcaaacatctgaggtgcctgcttttgaataacatcggcgccttctcctgtaatgcccccttttgtcgccaccctatcgacggtttcagcaaaggtgaggcctcgttctacaaggacttgacctgtgcctaaaagggcatacgttaaaaattcatacgcttcctctaaggaaagctcactgtttctcacagcagctctcgccatttcttcaaaaagagcagcgataaaaccaggagatgagctcgtcaagttactcgccgcatcaaactggtcttcccctatttcacgtacgatactaaaagctgaaaggagacgatgcaaacgcaccttttcttcctctccagcagtttcaccatgcgcaacgagggatacgcccgttccaacagctgacgtgagcgttgggatgtatctggaaattgggtgagtcgtatgctttgataacttgtctaacgtcacagccgcggctactgacacaatatgaaccgatttggctgctgaaggcagttgatcgagtacatcaagtacagcaagcggcggcacgcagataaaaagtacatcacatgacgcagaaagttcgtctaatgagcagatgtttatttcttgatgcttgtctttgagttgaagcaggcggtccgtttcacttcttgtatggatcatgatttgatgggcattgagcacttctttttccagccatttttgcaccatcatatcagccatgcttccatatccaatgattccaattttctccacagtttaatctcctctatttggcttagattcactacttattttaacaatttcccacaatgttttcatttttatcccacacttttttcttacgataaagccaatcgccacacataaggtcatcccacctcgaaccatacatgaaaaattgaagaaagagagtgattcgaatgacacatcacaaacatgaaaaccaaccttctcatgagattcaaacaatgaagcagccacaaaaacaaaagaagaagccaaacagctggtttaagccatttgttagcggcattgtaggcggcatactagcgttaggtgtgtatgtccttacggcatttgcccagcacgcatcaaacaacacagcaagcgattctgctgcaaaaacagaagctgtatcaacaaatgatacaagtgccagttcgtcaaaaacaactgctgtccaaacatcacattcatcaagcagtatctcaagcatggtcgaagatgtatcgccagccattgtcggcattacaaactatcaagcgcaaagtcaaacagacatgggctttggcgatttcaatacgccttttgatgaatcacagcaaaataaaagcagtcaagaggaaaaaaccggtacaggctcaggggtgattttcaaaaaatccggcagcaaagcctatatcttaacaaacaaccacgtcattgaaggggcaaataaactcacagtatccttgcacgatggcaaaaccaccaaaggtaaattggtcggagctgacccgctgactgacctagcagttgtagaaattagcagcagtcatgtaacgaaggtcgcgtcattaggcgattcctcctcgctgcgtgctggggaaactgtcatcgcgatcggaaacccgcttggtgaagatctatcaagaaccgtgacccaaggaattgtcagcggtgtcgaccgaacagtctcaatgaacacatcagcaggcgaaagcagcattaatgtaattcaaacagatgcagctattaacccaggaaacagcggcggaccacttcttacgacagatggaaaggttgtggggatcacgagtatgaaaatttctgaaacaggtgttgaaggtattggattcgcgcttccaatcaatgatgtcaaaccaatcgccgatcagcttctcgcaaaaagaaagattgagcgtccatacatcggcatcagcatgctggatctcgaacaagtcccagacatatatcagaaagaaacactcggtctcaaaaacagtcagcttgatcagggcgtatacatcaaagaaatcgccgcaggctcacctgccgccaaagccggcttaaagtctgaggatgtcattaccgccatcaatgggaaacaaatcaaaaccggaagtgaattacgtcatgaactatacacaaatacgaaagttggagacaccgtaaacatcacactcattcgaaacggaaaagaagaaacgaagaaggtgacattaacacaaactgaatctaagcaggtaagttcctaatgcaaaagaaaaagggctaaaatcaagatgattttacccttttttcttttcagcgcgatagaaaacatttgcagacctgacaaaaaacgcaagggtttgtctatacgctgagcagctcatgaatgaactgctttttatgatgactgaattggcgttaatctctgctcaatttctgctcgtttgtgctctagaaatggaggaagagctaattgatcgccaagctcatctactccttcgtccactgtaaacccaggaccatctgttgagatttcaaataagataccattcggttctctaaagtaaagggctttaaagtagaaacgttccacaacaccagagttcgtgaagcctgcttttgatattttgtcataccatttttccagttcctcagcatcttccacgcgaaaggctacgtgatgcacacttcctctgcctgaacgctcagaaggtccttccgttttttcgatcacatgaatttctgttccagcaccgccatttcctgactcaaaaatggtcacgatctcaccatcatttgattgttcacgcgctctttcggtaaagccaaggatgtctgttaaaacacggatcgttttgtccgcttctgcaacagttaattccactggccccaaacctctaatggcgaactctgccggaatatcatcatgcactggcggtgagcctgcttcttgtgcgttcggttctactgttaaaaatagctgctgcccttctggatcttgaaagcgcaaggcaggtctaccccctcttaaggaagccgtttcttgctgcacgcctgtctcttcaaaacgcttttcccaaaatgaaagtgcttcttcagaagaaacgagaaggcctgtgcttgtgatggcatttgttcctttcaaacgacgggcgagcattggaatttcaaagaaggtgagctccgttcccggtgaagcgacctcatctccataaaataagtgatacatagaagggtcatcctgattgaccgttttctttacaagttttaagccaagaatctggcggtagaaatcaacattcttttgagcattggctgttaatgcagatacgtggtgaatcccattgattttcattatattcactcctatttcaaaatatctcgaattcaagataatatccttatgaataaaataggtcatttttcaagaaaagtcaaccatttggctagatgttcggtttctaacgataaaattaacattaaatcaaaaataatcttttatcgttcgtttttaacgaaacatttaccctgatttctccaataaacgaacacttttaaatacaaatacgaaaatcagaaaatttttttaattcttgttttcctaaaatcgtattacaatgaacaaaatacatgtcacagtaacgtacgaaagtgatgcaggaggtcgtgtgtaatgaacaaagaacaaccagcgttaaaacaggacatcggcttatttttcgccctatctcttgtcatcgggacgattatcgggtccggcgtctttatgaagccaggcaacgtcctttcctattcaggaagctcagatatcgcattattcgcttggctgctaggtggcattttaacccttgcaggcggactcactgttgctgaaattggcacacaaatccctcggactggcggattgtatgcctatcttgaagaagtgtatggtgagttttggggctatttatgcggctgggtgcagattatcatttatgggcctgccatcatcggtgcacttggtctttattttggttcattgttagccaatttattttctctttcttctttatggtcgacaacaatcggcattatcactgttttatttttatgtttaattaacattatgggaacaaaatacggcggttttgtacaaggactgaccaccatcggaaagcttgtcccgattgccgctattattgtgtttggcttatggaaaggaaacgaaaatattttgatggcagtcaacgatagtatcgctcaaatgaactttggtgcagcgattttggctacgttgtttgcttatgatggctggatattgcttgcagcacttggcggtgaaatgaaaaacccagagaagctactgcctcgcgcaatggcaggcgggattttaatcgtcacggcttgttatctctttattaatgttgctcttttgcacgtgttaccagcagatcaaatcgtacagcttggagaaaatgcgacaagtactgctgcgacaatgctctttggaccaatcggcggtaaggtgattagtatcggcatcatcattagtatctttggctgtttgaacggaaaggttctttcattcccacgtgtgattttcgcgatggcagagcgaaagcaaattcctttcgcaaacgcgatttcgcgtattcaccctacatttaaaacaccgtggattgctgtatttgtacaaattttgatcgccattgtatttatgatcgtcagcaatccagaaaaactgtcagaggtttcgattttcatgatctacatcttttatgtcatggcctttttcgcagtctttaaactgagaaaacaaaacaaaggaatggagcgtgcttatagcgtaccactttacccgctcactccaatcgttgcaattatcggttctttattcgttttaatcagcaccatgatcaccgactggaaaagctgtctcatctccatgctgatcggaattgctggactgcctatttattattatatgaaaaaagcacataaaaaagcagagcgctaatcagctctgcttttttctttcttcacagcgtgatagaaaacctttgctttctagaaagaacgagcatccaagcgcagacctgtcaaagaatgcgaggttttgtctaaacgctagtgctctgctattttttatattgcttaatcactttgtatgattcgtttaaatatctcatgagccggtatggcttactaagcacgcggattgggagtcttgagataaatccattcaaattcgccttatattcctgcgtcatccgttttggctttgtcgcaattttttcgtatacttctttgtaaaattccttcatgatgtcgacttgcacactgatcttctgatgacactctgtacactcaacgcttttcatctgatcattcacataaacgatgctgtggagggtctcttcttggcaccgagtacaatgtaggttcgcttccatttcggttttcttcaagatacacagctcctttctcgtttgatgttgctctttttatacaattcgatggctatgagccgtttattggtcggaagcttcctttaaaatggctgccgccgttagttcgtctgtcaccagcacttgaatgaatccgccatttaaagcccctaaaatactttcagctttatgggttccttctacaacagcgatgaccgttttgacgctctttaactgctccagtgataaaccaatgaccttttgattcaattcatcttggacaggtttgccttgaccgtcaaagaaacgaaagccaatatcacctacagcccctgattgccttaaaccagataaatcctcttcttttaagtaaccaactgtttttaacgttgaacctttatgcgggttgccaataccgatgagggcaatgtcgacatttttaccttcttcaagcacagcttctatatcctgcattgccataagccgctcttttaattcttctgtttctaaaatcgccggggcatataaataggaacacgtgccattcattttctttgccagctcatatgccagctgattggcatgaatgtcgactgcctgcctgcccattccaccctctaatggaatgaccttcacatcgtttcttcgctcgaacgggtattcctttacaagctcagctagcgtagttccccatgaaatgccgattttctccgcatctttcatgtttttagataaataataggcgccagcttgaccgacggcacgtttcaccatctcagacattgtcccgacacttgggacaacaacagcatctgttaattgaaaagttgtttctagctgcttttccagttccaccgtgtgaatactttcgtctttaatgtacacctcaacgattcccacatcttttgctttttgtaagagctttgaaatgactggtctcgagacattgagcttttttgcgatttcctgctgcgtccacccgtctgtataataaagatgagcaactttgacgagctgtcgtctttcttcccaattcagcatgtgacatcatccttttaatatactatgattcccagtataccaaacattcgtttctaattggaacaattgttacgaaaatgacaaaaagagcgattacctctccgctctttttccctccgtatattttggctgatacgttctcccgccgtctaacaggataatttgtccgtgcaaatagcttccctcgtcacttgtaagaaataaagtgagtcctgcaatatcgtctggtcttcctaatcttccgacaggaatgagcgattgcagctgccttttctccacctcagtaggatagagcgtatcaagcatttgagattcaattacgcggggggcaatcacattgatacgcacatggtgcgcccctaattcctttacgagcgaacgcatcagaccaaaagcacctgcttttgaggcgtaatactgaatcccgccgcctgagccagttatagcagatcctgatccaatcatgacaatgcttccttcttgccactcacatatataaggtgctgacgctttgatgcaataataaagaccatacaagttcacagccagtgtctttttccaaagtgaaaaatcgacttctaaaaaaggaagtgattttgtcatccctgctgaatacacaagatgagcaatgccgcctagctccctttcagctgctgagatcatctgctggacactttcccacgatgaaacgtcagcttgaaatgtcagcagctcagaatgctgtttttttaaaagtgaaagtccttgttcatctatatcagacacagccactctgtgtccttcttttaaaaaacgctcggcaatttcctttcctatcccttgggcaccgccaacgatgagaactggtttttgatcattagccagcactctcacccccatcaagcataatcgctgcaccatctgtaaatgcgccatatgatgtacttaaaaagaccgtcatatgggccacagtctccttgatttgctctgtgttaggaatcaaatggagaggcggcggtaataaggcgagcacccgaatgcctttgtctttaaattctcgcgccagcccttttgtcatggcattcagcatagaattcgatgtcgcatgtgaaatcccgccatcacctgtgatactgcctgatgacgatatattaataatacagcctttcttctggtcaaccatgtgccatacggcagcttgactggaaagaaagacagtattcacagctgtttccacttcgtccatccattcattagggtgagtggcatcaagctccgcttccgttccttgcgctgcttgattgaccaaaatatccagtttcccgcacgtatcgatcacttgcctcagcatacgcgtggcatcacgcggcgtctccagcgggttcatgatgatactcgcctgaccacccattttttgaatgtcttcacaaatggttctagcctttgattcatcatgaaatgtgtgtaaaaaaacatgtgcacctgcccgggctaaagccaggcagatggcttctccaaacccatctgtgctacctgtcacaagtgccgctttctgatgaagctggacgtgcacatgcatctcctccctatcccttgtttagcatttattttctcagcttactcacgatctcaagagctgcttcataaaaaccttctgagatggtcggatgcggatgaatcattttcgccatctcttctgctgttccttctaaatacataaaggaagaagcttctgaaatcatctctgtgacatgcggaccaaccatcgttgcgccgatcacttcaccatatgctgtatcgtacaccaatttaataaagcctgtttgaacacctgccgctaacgctttaccacttgccgctaaatcaaatcgttctgtttgtacgctgagccctttggcttttgcctctttctccgttaggccgacacttgccacctctggtaatgtataaatacatctaggcataatatctgcattcattttttcaggcacgccgcaaatattgctgaccgcaacagcagcctctgccatcgccgcatgagccagctgataaccgccggcgacatccccaactgcgtatacaccatcagcacttgtctgcatctgatcattcaccttgataaacggaccatcgagctgaagatcaagctggctaacagctgatacattcggttttcttccaacgcagacaagcagtctttccgctgtaaagatgtgtgtctcccctttatcatctgttgcatgaaccgctttgactccttcgctttccgtcaactctgtcacagtggtcttcttcgcaatatggatgccctttttcttgagttctctttctagcagcttagatgcttcttcatcctcttgtgggataatggacggtgccgcttcaataatggtgacttttgattgaagactttggaagatacaagcaagttcaagaccaatgacacctccgccaataatgacgacagaagcaggaatatctgggatgtcaaagattgtatcacttgtatcaaatgaaatatccttaagccccggtattggcggaatggccggtgaagatccagtagcaatgattaactctttcgtttcaatcgattctgatccaccttgattttctatttcaatccgatgcttggtcaccgctgtgcctctgccgttatatacatcaatctttccttgctttaataaaaaggcgattccacctctgagcttttcaatgacgtcatctttgcgctttctcattttatcgaaggaaaggatcatgtcacctgtttcgattccccagcttttcgccttctcgattgattcaatgacttctgcatgtttcagcagggtctttgaagggatacagcctcgatttaaacaagtaccgcctagaaaatcctcctcaatcaaagcaaccttccgtccgcgctcagccgcttgaagggcggcagtatacccgccaggccctccgccaatgactgtcagatcatacgttttcgtcatccgattcatctcctacattagcaattcaaatggttgttcaagcacttttttaaggtctgttaaaaaggcagctgctggtgcgccatctaccactcggtgatcaaacgataaactgacacccatcattggccgcacctgaatttctccatccactgcaacaggcttatcttgaatccgtcctactcctaaaatcgccacttccggctgattaatgatcggggtaaaggtatcaatggcatacatgcctaagttactaatcgtaaaagtggaccctttcagctggtccggaagcagcttttgatcgcgtgcgtttcggccaatttctttcgcttcttttgttagttgttttaatcctttttgattcgcatgagaaatgactggtaccatcaagccgtctttcactgcaacagcaagaccaatgtgtacatcctcatggaaatggagctcattttgttcaaatgtcatattgatctgcgggtggcgcgtgagtacatggctgaccgcatgaatgatgatttctgtgaacgacaaccggtagcctgtctctttttcaatcgccgggagtagctgctgacgcacttcttttgctttcgtcatatcaatttcacttgttaatgtgacgtgcggtgctgtaaaggcactttgtgacatgcgatcagcaatcacttttctcatgccagctaatttttgtgttttcacaggcgaagcctctgttgtttgcgttgctgctgcttgtacgtcactcttcatgatcttgccgtgagcgccagatccagaaactgctgctaaatcgatcccttcacgagcagcgactttttctgcaagtggtgagacgcgtcggtctttctcactagaatgaacgactgcctcgacgtcccgcttttggactctgccttttggtcctgtgccagatacctcttgaatcgccacatgatgatcttttgccatttttctcgctgcggacgtggcacgtactttttcatcagatgtttttggagcttcagtagaactggatgaagacgagtctggtgaagatggttcgctgctttctgaggaatcctcatctgcctgtgctggcggctcgcttggcacctgttcatttgcctctccaatatatccaataacagcattgactggaatttgatcatcagcttcgtagtatttttttagaaaaatgccgtcatcataggcttccacctcgatgttgatcttgtctgtcataatttcaaaaagaggctcaccgatttcaaccgaatctccttcttctttaaaccattgaagcaaggttccgatctccatcgtactgcttagcttcggcataaatatctcttttggcatgatcttctcccctttatttaagagcgtgcaagctcttttgctgcttcaataatatctggcacttgtggaatgaccgctttttccagtgtcgggttgtatggtattggaactgcaaggccgccaagtcgtttaatcggcgcatctaagtagtcaaacgcttcactttccgctatcatacttgcaatctctccgccgtagccgcctcgtttgaccgcctcatgaaccacgatacatttacccgttttcttcacagattcgataatggtttcttcatctaatgggacgagtgttcttgggtcaatgatttcaacatcgattccctctgcttctagttccttcgccgcttctaatgctttgtgtaccataatcgctgttgctacaattgtgacgtccttcccgcttcttttcacatcagctttccctaaaggaatcgaataaggctcttcaggcacttcgccgattgttttatataaaagcttgtgctcgtagaaaatgacagggttgtcatcatccattgctgcttttaaaagtcctttggcatcataagctgttgaaggctgaaccacctttaatcccggaatatgagccatccacgcttctaagctttgtgaatgctgcgctgcggcacctgttcctgatcctgctggtgttctcacaacgagtggtacttttccttttccgccaaacatgtatcgtgttttagctgcttggtttacaagctgatccattgcgattgtaataaagtcagagaattgaagctctaaaatcggacgcatacctgtcaaagccgctccgactgcacctcctgcgatggcagcctcagagattggtgtattgcgcacgcgctctggaccgaactcttcaatcatgccgcgcgtgaccccaaaagcaccgccatatacgccgatatcctcacctaaaatgaatacatcttggttctctctcatttcctgactcatagcctctcgaacggcttctaaatatgaaatctctctcactgttgtttttgtcacgtgattcccctcctaattaggcgtatacatcctctaatagtgtatcgattgacggttctttactgtttttagcgaattctacagacgcttcaatttcttgcttcgcttcttcctgtaaaaccgctgcctgctcttctgtcaaaacatttagttcaatcaagagagatttaaagcgcttgatcccgtctttttgtctccactctgtttcttcttcacgtgtacggtattttttcgcatcactcttagagtgacccttccagcgatacgttttcatttcaacaagtgatggaccttctccagctcttgcacggctgaccgcttcatctactgtgttcataatctcaaccatgtcatttccatcaattgattttcctgggattccatagctttctgctcttgttgaaatgtcttcaatgttaatcatttcttttacagggccagacataccgtactggttgttttcacaaatgaatacaacaggcaaatcccaaatggatgcaagatttagtgcttcgtgaaagcttccttcatttgtcgctccatctccgaagaaacaaagaacgacaaagccttcctgtttcattttagatgtgagcgctgcacctgttgccagcgggataccgccgccaacgattccatttgcgccaaggttccctttttctaaatcagcgatatgcatcgagccgccttttcctttgcaataaccagtctcacgcccgaatagttccgccatcatcttattgacctctgcaccttttgcaatacagtgaccatgtccacggtgcgtactgacgatcttatcttcgtcctttaatacggcaattgatccaacagctgacgcttcctgtccgacacataaatgagtggttccatggataagtcctttcgcaaagaattgatcgaccttttcatcaaaatatctcactaaccacatttgtttatataaatctgctaatctctcatgactaatctgttcaggcaaagtgatttgtttttgcatttattctctcccctttacatttgttcttgtgtgttacatttgtaattatcatacgtttaagtatcattgaagtcaagcatttctctttcatttttaagcgttttcaccttttatcagaaaaaaagagaaaggcaaagcccttttctaaagaacttctctttctctcccaatcccttacgttctcatttatctggatacatcatgattttgacactctcaccttcagggtgccttgcgcattctatcgcctgaaggagctgacttaacggataacgatgcgtcaccatcttttctgtgttgaccacttttgctcttagaagttcaagggcttcgaggtagtgataaggatgcgaggaataggctcctactactttcacttcatcatggaaaaaccgatcagccggaatggagacgtctccctttgggaaatgagcaaatactaaaatcgttccgcctctcgctactgcttgaaacgcttcttttaaaagcgcactactcccaacagaaataatgacgaggtctgctccctttccatttgtttctctcatgacctggtcttccaccggctcagaggctggatgaaaagcgacgtctgcccctaaatttctcgcttgcagcagccggttctcattcacatccgttatcatcactttcccagccaagtaatgtttggcaagctgtagttgaatgcagccaatttgccccgctccaaggatcagtacagaatctcctggatgaacaggtgctcgttcaaaaccgtgcaggcagcaggcgactggctccaccatcgccccttgctcatatgagacgtcatttgggagcttgcccattgtgtgcttgacatgtaatgcaggtacgcggatatactctgaaaacccgcctggctctacattagtggctgcaaactgcggacacattgtataaaatcccctttgacaaaagtcacaggtaaagcaaggcacatggtgcgcaacataaaccctgtctcccgtttttatatttgtcacatgctttccggtttcaacaatatcaccagcgatttcgtgccctagtaccgttcctggaggtaccgtctcatgtgttgctttgtaaatatctgtgccgcataagccgcaggcacgcatccttaatagaacttcatcatcacttatcgcaggccggttccgcttctcataccgaatgtcctctgaagaataaaagacagctgatttcatgtagctgcatcctccttttcatcacctttcgcaaaatcctgcaacgtttgcacaagctgcttgtactcactcatctcactggatatccagtaacgtcctccgaatatacgagatgggcccaccctgacatagacttttccgatatgagggtatggcttaataaaaagctttcctttaatatcagagaccgcatatgtgtgccatctgccaaacgctccgattttgagtttatcttcactaatgatgacgtttgtcggctggttcagtccagtgatactagaaagcatgaggataggcagcgtataaacgcctaacacagctaacggttcaggccctgctgacattaacgtataaagagaccaaaggaaaaacagacagatgagtacggctggaagaaaaatagacaacactgcagacgttcggctataagcatgatgctgcatgagacgtcctcctttcagagatacatagaaggagccgggaaagctcctccatggaatgattgtttacttaatatgatcgatgattttttcaatatcatcttcaatgccaaatccggttaaaaaggataatgtttgaatcacaggcgttcctttcgtatcactcactggtgttgtcgttacgattaaatcggcgccctccgctttttgcgggacttcagatgccttgcactgttccaccacaacatcgtatcctttttcctttaacgtctcttcgacctttttagcaacaaccgttgatgttgcaaccgctgttccgcatgaaaccaatattttctttgccataagaatccctccagctcgtttattgatctttctgatctaagcccatttctttcgcatattgctttctaatatcatttcgcacccagtaccatagaagcgcataagccaaagcacagatgatggctgcaataaagtatgggttgctcggatcaagaagtctcaccatgatccaaggaatgacgtgggaaccaaggtcaatacctgaaatcatattggctccttctgggaagtcaaatccgactgctttccccattgttgtcgcaagcggtgcgagattcgttgcgataaagaagacaatcattaatgtaaaaatactgttaataagaccgcgaataatattcccacgagcggctgctactgcccatacaactgtaaacggtagaactgataagtcagcaaacggcagcatgccattgtaaggcagaacgaccgcaagtagaatcgtaatcggcaccataagaagagctaccgccatatttgccggatgaccaattacaatcgctgtatctaaaccaatatagacattttttccagggaagcgcttttgaatataagaacgagcgccctcagagattggaataagaccttccattaataacgcaaccattcttggcattagcacaagaactgctgccatttgaatacctagcgtcatgacgcccttcgcatcatatccacctaaaagaccaataatgataccaagtatgagacccatcacaagtggttcgccaaaaatgccaaaacgtttcttcaatgtttctggatcagcatgaattttgtttaaaccagggatcttgtcaatgatgcggttagacgcatacataagcggcgcgaagttgaccgtttcagcatgagccatcgatacgcctttcaatccaaagtggtgttcgattgtcggtgccgtccaatcggctaatttaagtgtgatagcagagacgatcaaaccaacagcaagtgccaagaacatattatgataagcgtaataagtcacagaggctgcgaaaatcaaatgccagaagttccaaatatccacattcagtgttttcgtaaaattaacggacaataagatgacatttaacaaaagcacaagaggaatcatcaaaggggcaacgggtgttccaaaggatatagcagctccaatcggccatccaacatccaaaatatcgagctttagcccaagggaagtaaccatggcttttgctgctggcccaaggccgctcacaagcaaattaatgacaaggttgacaccgacaaacccaattccgatcgtaataccggctcggaaggatttcttaaagccttgccttaaaatcataccgaaaagcgtcataataatcgggagcataatagttggtccaaggtctaatataaaatcgacagcttgcttgatcatacatccacctcctggatttttcgaataaagcgcttacattattttatcaaaggctattggtttaattctttctgaagcaaagcaaccgcttcttcatacgacgtcatgtcagacagcttcgtcatcacctcttcttttctaaaaagtgtcatgagcttctctaacatcacaagctgcttactaggttcagagattgctaggacgaacacaattttggccagcacagtttcatcagggctccccatcttgtgaaacataacaggttcctttaaagtcgctacactaatcgccggtttgttcacatgctcaggatctgtatgtggaattgctaccccaaaggtcgcaagtggaaggcctgtaggatatgttttttctctttcaagcaccgctggtaaaaagctcgacttaatatatcctcctacttctaattgctctgctaaatatgtggtcacctcctctctcgaagatgaatcgtactgcagcttgatcagttgttcatctaactcaaacaagttgttcaaacaaccacccctttcatttggtataaatgtgaacacatgtaacaaaaagaaagaacattttagaatagaaccttttataaagcgcttacaaatacacatatagaaaaatgttcaatgttgttacctttgtaaagatattataatattctaaattataagtcaatgttcctaggaaaaattttataaaaaaaagatgcagtcttttctgcatctttcatcaactctgctctacttcttattaaatgtgacttcttctaatcactcagtacttgctctttgatgtgagcaacaactttgtcattcatacgcaaaaagacccttagccattgaaatacattacagtctgtacttcaaatggccaaagcgtcttcgatcccctgatccgctgtgtttcttttatataaataaaaaaagaaacgccatcctcaagaggcgcttcttttcccgggaaatgttcttattgggcagagagctttaaatcgacgccaacggcagttccgtttcttgaggaatcagccactccagtaaaggttcctgcttttcgatcaatgagtagcgcttgaacatttcctatatcaataggcgaattgccgaaacgatgccccatatcattaagttttgttctcacatcgagagggacacctacttcataacgataagaagtaggactgtttgtataaattcttggttcttcaactgcatcctgaagctccatctcatattcaagcaaattcaaaatagtttgtgaaacagaagcaatgatggttgttcctcccggtgaacctactgtcatgacaggctcattatctttaaaaatgatggtcggtgtcatactggacaacggtcgtttattcggctgaacttcatttgctccgcctggtattgcatcaaaatctgttagttcattgtttaagaagaaaccatattccgggacgagaatccccgtaccaaataactgttcaatggttgtcgtgaacgacacaacatttccccactgatcggcaacagtaaaatgtgtggtctccccaatggttttatcttcaggctgcggtacaataggagatggatttttttcatcctcatacgcccacggatctccttctttcgggttaagattctttttgtctaattgaataagagaggctctttctgaaatgtaatcatcgtctaatagtccttttagtggaacatctacgaactcggggtcgccggcatatgcagcacggtcagcataggagagatgcatcgtttcagcaagtagttgatatttttcgaatgatttggggtcatattgagataggttaaagtggtcaagtattttgagcatttgcagcataaacaccccgcctgagcttggtggaggcatacttgcaagctggtatcctttatagtctccccagataggcttgtcagtctcgacctcataacgaccaatgtcatcagttgtcattgtcccgccaaaatcttggactgtatttgcaagtgcctttgctacttttccttcataaaatgctttgcttccttttttcgcaatgagcttaaatgtttttgcaaggcctggctgaactaggaggtctccttctttgagcggctgatcatttggaagaaagatgggcgctgcagccgtttttttcaattttccttgatgatcatcaatggcttttgccaagacagaatcgatttcaaatccatcctctgcaagctggatggaaggcttaatcaattccttcattgagcgggttccccacttatctaatgccgcctcaagacctttcacagtccctggaacaccaacagcattaccatgtgtggatcgctcagcaaacgggatggctttcccctcatctgttaaaaacatgtcaggtgttgcgccttgtggtgctctttctcgactattgatgatggatgtttcttttgtcttcccatcataaaccatcataaatcctccgccaccaattccagacatcattggctctgtcacattcagtgcgtactggatggcaacagcagcgtcaacagcgtttccacctttctttaatacatctgcacccacttctgatgcgagcggatgggcagtagccaccatgccatctttcccaacagctactttattcccatgagtttcgtttgcagtgacctgaccgacaggcagaaaaaacgagaaaaccaacagacatatggacaaaatagttagagaaatgcgtttcatacacaacaccccttccatattcttactttgaccataccgacttcttgaccagaatacaatagattattctaaaatttctaaaattttcattctatcatcctatattcatcaaatgtaaagtggattttcaaaacatatgacacacgtaccaagtagggataaagacactatcctttcatgtttttgatttcgcggtataataaacgcatcgcaaagggggaagaatgatgaatcaaaaaagcactttattttgggaaacatattggaaagaaaaatcagaaagcgcaccaattgacgcatctgtttccgcttgggcatttggagcagacccagatcatttacttgaccttgttctgcaagggaaaaaaacagcgacatgttctggacatcttttttacgaaaaggaacaggagccgcttccaaaggcagggcaatatgcggtcattttggacagccatgacgaaccaaaagccatcatagagatcacgcatgtagatgtcatgccaatgaatgaagttccagaatcatttgcccaagcagaaggtgaaggcgatctttcttatcactattggtacagagcccatgaagcatttttcacagaatcactcaaaccgtacggattagaatttaaagaagacatgctcctcgtttgcgagcgatttaaacttgtttattcagcttcttaagctttaagcggcgccaaaaaaggaccgcttttttcatttcttttctcctttctgaaaaaggtgtgatgagaacacatctttaggtcagaataagatcaaatagaaaaagtgaagaaattttcgactacacctgttttttttcgacaaaagaatatataattatttgatgtgtgcattgtctcatttatacaatggagggtttttacatgttaaaaaggaaaaaagacaagttttccgtcttgttaacggaaattgctaaaaatttagatgaaactgctgagtattttgttagctataaagtaacaaatcaaaccactctgaaagaattttctgacacattgaaggaatatgagacaaaaggtgataatcatgttcatactatgattaaagagctgaacaaagcctttattacaccgattgaacgtgaagacattcttcaattgacgaatagcctcgacgatgttttagatggaattgagcatttttcagcgacaatggaaatttattcaatgacaagctctgacgaacatatcgacaaattcagccactacatcagagaatgtgcgaaggaaattttaattacaatcgatttactggctgaaaatcgcttaaaagatattcaaccacacgcaatcaaaatcaaagagatcgagcacaattgtgacaatctttatcgtaaatcactcaagaacttgtttggaaaagaaacggatccaatcaaggtcattcaatacaaagaaatttacgaaacacttgaagaaattgccgattcctgtcaaagtgttgccaacaatctagaaacaatcataatgaagaatgcgtaacggggttagttaaacatggacacattactcatccttaccatatttattgtcatttgtgcacttgcttttgatttcatcaacggattccacgatacagcaaatgccattgccacttcggtttcaacaaaggcgttaaagcctagacatgctattattatggcagcgtttatgaacttcttaggagcaatgacatttacaggtgtggcaaagtccattacaaaagacatcgcagatccttttacacttcaaaacggttctgtcgtcattttggctgctttaattgcggccattacttggaacttgcttacttggtattacgggattccgagtagttcttcgcatgcactgatcggatcaattgcaggagctgttattgcctctgctggttttggcgctttaaactattcggggttcattaaaatcattcaagcactgttgctttcacctatcctagctttcgtattaggatatatcgtgtacaccattgtcaaatttatatttagaaaccacaatctcgcaaaaacaaataaacaattccgtcgtgttcaaattttaactgcagcactacaatcgtatacccacggaacaaacgatgcgcaaaaagcgatgggaattattacgatggctttaattgcagggaatttgcatacaacagacgatattcctttctgggtacaattctcttgtgcgcttgcaatgggactaggtacgtctattggcggctggaagattattaaaacagtcggcggtaaaattatgaaaattcgtccagtaaacggagtatctgccgatttaacgggtgcagctattatcttcggtgcgacatttattcacttacctgttagtaccactcacgtgatctcatcttctattctaggtgtaggttctgcacacagagtaaaaggggtaaactggggtacggcaaaacgtatgcttgtcacttgggtaattacattaccgatttcaggaactctcggggctcttatatactttgtgttaaatgcgattatctaatatcaaagacctgtctgacaggtctttttttatttgtctgcacccttttcctacaagccattttttcatgaagcagggtttccaatcatatccatagaaataaagtaagtatccatctgtctatgggagagaaaatcatgctattattttttcaattgaccgtgtggttattgctgggtgcccttgctgtatatgtatttgccgtatggcgttttgaacaaaaagtaaaagaaaagatgtttgccattcgtaaaacgtggtattggatttatgtagctggtgctgttgtatactggacaaatgacccttcttcaatcttcaccgattggatgcactacttgattattgccgtttttttcgcattaaccgatgcattcatctttctcagctcctatattaaaaaactcggaaatcacgaactagaaaccgacacccaccaactcctagaacaaaataacgatctacttcattcttacctcaataaactaaaaacgtaccaatacctattgaaaaacgaaccgattcatgtatattatggaagtgtagaggcatatatagagggaattgaacggctcatttattcttttgccgacaagatgaatattcaagcagttctttgtccttacgatacgcaggaacaaaaagatgacctgctccggacacttgaccagcgagctcttattcaggcgaagcttgacaggcaggaagtctattacgatgatttcggcaaattggtgctcatcccgttttctgtagcagatgatcacttcgtcattaagctcacctctgatgacattgtcactgagttcgactatttattaatgacatcacttacaacaatttatgacctaatcttgcctgacgaagaggaaggtgatgaagatggaccacgcacttcaaggggataacaacaatcgcaagaaaaacccttttaagattttaaagaaaaagcaacatatcagtatggcggattacaaggtaagcccccatacagaacgtatttttaaaaagaatgaacagctattggatgagtataaaaataaaagggcatgattacactaaaggacgcggaacaaaatccgcgtcctgcttccatttttacatagacttgcatacaataatctatacgctgcaacgattgaggtgccaataaatgaaaaagaaaatcaaacaattgagatatgttcagtttgctgaatttaagtcgtcgccttatatgcgtcgattaaatgaacaaagtgaagcagtcatccaatcatccaaacagaaacactcactgatttaacagcttcagaagcttttccttcgttttaggtccgtataccccatcacttgtcagaccatttaccagctgaaaacgcgctacggcgttcgccgttttttctccgtaaactccgtctattcctttatttgcagctgctttatcaggataaaaataaacagcagcaagcgcctgctggacgaggcgtacgtgctctccctttgtcaatggagaagtcacctttaaaaccccatctggcagctcatacaagctctttgcatcgttacgataaattttgagaacttgtccaatttgaatcttattcggatcactaatgtcattccacttctgtaaatcttgaactgtgaccccatgagcttttgcaatactcgttaacgtatccccgcttttcacgacatatgtgatgaccgtctcaggatcttctgctgtttcaatcccttttttaaattcattccaagtagatagaagctggcgtggacatgcttttcctgaccagtactgatgtgtgaccacatttgctagcggtatgtgatgttcttttaacagcttttgaatgagccattgtgcatgtttgaccgcttgctgaaaattcccatctacattctcacaaatttcaattccgatcgacttccggttaccattcccatgaccatcccctgcatgccaaccattttcatttaacggtagatgctgaaagatttcatgatcatccactgtaaagtgccagctcacctctgtcgttgggctttttacataggccgcatgacttttcgcatccgctccctttgacgtgtttgctgtgttatgcaccgttacatactccggtgtcatcgcataccctgggcggtttccgtttccaactggaataaaatcttgataaatttgtaccatgtactgcactcccttttgctagattgaattgatctttctcatcaatcggtggcattcgtaagacaatacttgtttgttttcatgagaagactatggtaaaatttgaattcaattcactctttttagtcgtgaaacgtgcaaaaatacagaaaaaaacaggaattaattccatttttccttgattttatgttaaaattgttaaaaataaaccgataataaaagtaagtaatagctcatttagctatttagtcctatatggacttttcttttacgccaaaaatagaacatacgtttgtatggaggttttcaaatgactggttttttaacccatttagaagaagatattaagcgtttatatgctcaattacaaataagcggtcctgcttatagagagatgcaaaggatcgcttctgaatttcgcgtatgggtccattacgaggagactggcagcatgatgatccagcatcaaggtctttacagtattatcttaaacagatccctatcacctgaagaacagtggcaggattttgcccacgagctttgtcatgtgctaaagcatacaggcaatcatttcaaaatgaacaaactctttcgagaattgcaggagtttcaggcaaaacaattcatgtatcacttttgtgttccaacctttatgctgatgaaaatgaagcttccaccccttcggcagcaagccatttttcatattgctcaaacgtttcatgtcacttggacttttgctgaaaagcggcttgccttattcgaacagcgaaaagcaggtattcgctttcagcaggagtttacgtcttatttaatgaaagcagaaagagtcgctgaaaaagaagctgtttatcaaacgtaaattatcgcataaaagtttattcataaagagctaatacttgtttgagtacatttgtgtaccgataaaattgttcagtttgtgtatctcgccggtattgacgcctaaagtcttgaaagaatgctcttctttgcgcctgactaatttcaagttgtacactttttcctgtcagacatttgttattgatattatcaggatgcgttccagaaaaacgatcagattcagctagcagcaatgcgtgaaagccatttagcgttaaacgcttcacagtttctgccgctctttctctatctgtacctcccactaacgtttgaagcacctctgtttctccgtagccatgaagtgcaaacgtataatgatgggtatgcacctctgaaaggcaaagcggctcatcaaagcgtgtacttgtaatatgaagcacatgattgccttttactttaaggccttcgaataaatacatagaatagtcactagaaatttcatgaacaagctcactcacgcctgattcaattcctccagcatgaggagacaaaactagcagctggtcacctttccgctcgtgaagaatttgataatcaatcccttttctttcatgagcggagagctcttcataattttgatacgtatcgataatttgcatcatgtcatctgctccatttctttatatgagcataagtctactgatccctcattcttttgtaaagaggtttcgaatcaaatataccacttgaattcttccttaaattttccttacatttacggcattctgttgaattttgagaaaaaatgaccgataattgaaacgaatagaacttttggactatatgaatctttttgtattctctctcataaattagaaatattgtgatctacatctggaggaattcatgttaaaaaagaaaaccaccctcactcttatcatcttactccttagcttcgctggcattatttattggaaatgcttctctcttcaaggcgtgtctcacggaacattcatccgctcgatgtcatcacctgacggaatgtatatcatcaacacctatcagcatagcggaggaaagctaaaggaaaacgcagtcagagcagaaattgaaaacaaactgacccaccgcaagaaaacgatttactggaaataccctgataaggaccctctcatcaaatggaaaaacggacagcttgttcaaattggacatgagtttttaaatgtggtgaaaggcgacacctacgattatcgctttgatcagaacaagagaaaataacgacatacaaaaaaacgaatcctcttggattcgttttttacgttgccatgacggtttgcataaatttcttcatatctgtactaaccgttgtcaatcgatcaacaatttcgctaaattccgtcacaagtgaagcctgttctgatgaagaacctttcatatggtccatactttcaagtaatgtatgtatattggaggaaattccttgtaatgagctttcgatgttttctgttgcacgtgaagtttcacttgaaagcttttgaacctcacttgctacaacactaaaacctgctccgtcttttcctgccctggccgcttcaattgacgcattcaatcctagcaaactcgtttgtttcgagatgcctttaatcatttttgtaatatcggctgtttgtttcgagctttcaagagtttgctgcgtttgtaaggtcatctcctcacttgtagcagaaagctcctctgaatgcgccgccaccacgtgcaccttttcttgaatactttgaataatgtcattcaatgaatccatatacgcttcaagctctatttgatttttgagcggaaatcctaaagcgagggcaccaatcacttgcccgttttcatcaaaaatgggcaatcccattgcatttaaaggtactccatatactgattcaggcacaaacatactcgatgtctcacctctcagcgcttttttcatattcagatcatctggtttaatacgttcaccagctcgaatttgaaaatcaacatctttcgatggcaaatacagcaaaaatttctctcggtcaatgacacccatcgtcacttcattttttaaaatctgcatcatataaggtgctgctgtcactatactctgtagtatatccaatttctctacccccttatattatttatcggtcgcttttcttaaaataatagttattttttaaaaataatgatgatgaaagttatttctcatatgtatgagtaaaaagagggaaattccctctctatattcaacaaaacgtaaatttgctataatttaagtatcaacatatgatgaaatggtcatgtaatcattttatatatattcattggaggcgcatgttgtgagacaacctatgacttatgagcgggcgatcgtcattggcggcggtatgacgggaatactcgctgcaaaagttttatcaacgttttatcatcaagtttttattatcgaaaaggacgaaatgccagactctcctaagaatcgtctcggcactcctcaagcttttcatccacatagaatgctgccactaggcaagcaaatcgttgaacgtctattccctggctatacaaaagagttattgacaatgggcggatttaatacatggcaacaaacctctcgatttatcacaaaagatggtgaattaacgcttactgatacagaagaaacagccgttacaagacgtgccatgctagagtgggtgctaatgcaaagaatgttaaatgagggacgggtgcaatgtttagaaaaacatgaagccttctcacttcagttgaaagagggaacgaatcaagtcatcggactgatcgtgaaagatcggcatcaaaagccgggacgcatttttgaaatgaaagcagatttagtgatcgatacgtctggaagaatgtctaaattgccaaaatggctgaaagatgctggactgaccttaccgcagacagatgaattaagtgtgtcactcggttacagcactagatattacaaaataccaccagaagcgccataccagcaatcaatggtcgtcgtgggtcagccagacaggcaaattccaacaggactgtttgaacgcgtagatcatgatttagtagctgttcttctctctgcagctggcggatcacattatccaacaacggatgctgatcaatttgattcagaaacggctgcactcgcgcatccagcaatagcagaggccatcactcatttaacgccctatacaaaaccaaaagggtttagagttccttcttgcgtgagacatcactatgaacaaatgcacgaatggccaagtggattattggtgatgggcgatgccttgtgtacattagatcctattcacgggcaaggaatgacaaaggccgcactcgaagcacaagttcttgagcgtatgctcaaacaagcacaaaaaaataagcagctatcttttgaaaaggacacattacaacaaatgcagcatgccaatgaacttggctggtggctttgtgcgattgctgatatggcgtgggaaggcgttgaattaaaaggagaaacaaccattccccatttgacgttcgtacaaggatttttaaatcgttacgtacaatatgccatagtaacaaaacagcctgaacgtcttgaggcgtatcaccgaatgcattcttttttaactgaaccgagagacatcatcaacttagaacagctgcatgacatgattcaagccgacacttctggcgaaacggctgaatggtggagtcagtggaatcaagaggacgatgaacgcaatcgggcttttttccatgaagcggttcctgactttcgtttacagcaactactgtcattcaattgaaacaaaaaagcccctttaaggggctttttgattaacgtaataattgaagtacgttttgtggctgttggttggcttgtgctagcatcgcttgagatgcttgagaaagaatgttgttctttgtgaactcactcatttctttcgccatgtcaacgtcacgaatacgagactcagcagccgttaagttttcagcagaagcaccaaggttgttgattgtgtgctctaggcggttttggacggcaccaagtgctgaacgctgtttagatactgcgccgatggcttcatcaatttttgctacttcaacgtcaaagtcaaaaccatcttcatttactttaatatctttgacagtcaaggtttcagcgtccattttgccgatctgaacgttgatgttttgctcaatgttagcgccaatttgaaattggaatccatcttcaacgctaccatccaacagattttttccgttaaatgctgtacgctgagaaatcccatcaatttcatctaccaaagccgtgagctcttcttgaatagctgttaaatcttctgtttgttgagtcccaacgttacccgcttgaactgttaattcacgcatacgttgaaggatcgcatgtgtttcagttaatgcaccttcagctgtttggataagagagataccatcttgtgcgtttttagatgccatttctaatccgcggatttgtccacgcattttttcagaaatggctagacctgctgcgtcatctcctgcacggttgatacgaagaccagaagaaagcttctccatgttcttttgccctgctccattgtttgcagacaaacggttcagtgtgttaagtgctgcgatattgtggttaattctcatattaaatgacctccatgtgtttgaaccaattgaacatccttgtccaaaagttctaaattagaatttttttgtaagccttacaatccatttatcgaactttaatggaatttgtttaacaaaaaagggataaatgaggtaaaagtctcattcgttatgatcgtttcgctagagtatgccaaatctaaaggtcatttttcatgatttgtcagagggatttaagaatcataagactggagaaaatgcgaagaaaaaacagcataaaaaaaagccccataaaaggggctcttcattaacgtagtaattgaagtacgttttgtggctgttggttcgcttgtgcaagcattgcttgagacgcttgagaaagaatgttgttctttgtgaactcactcatttctttcgccatgtcaacgtcacggatacgagactcagcagctgttaggttttcaccagaagcaccaaggttgttgattgtgtgctctaggcggttttggactgcaccaagtttaccacgctcagaagatactttattgattgcagcatctactttgtctaataaagcatctgtattagcagctgtagcagttgttacaacataatctgctttcaacatatcaagaccagtagcagcagtacccatgttaccaatattaacagttaattgttgagttttgttagcaccgatttggaaagtgaatccatctgtagccgtaccatcaagtaattttttaccgttgaatgctgtacgattagagataccatctacttcatctaaaaggttgtcgatctcatcttggatcgctttaagatctgtagttgcatcttgcgtaccagtgttacccgcttgaacagttagttcacgaacacgttgaaggattgagtgagtttcagtcaatgcaccttcagctgtttggataagagagataccgtcttgtgcgtttttagaagccatttctaatccgcggatttgtccacgcattttttcagaaatcgcaagacctgctgcgtcatctcctgcacggttgatcttaagaccagaagaaagtttctccatgttcttttggcttgaagcgttgtttgcagacaaacggtttaaagtgttaagtgctgcgatattgtggttaattctcatttcctattacctccatgtatgtgggacctgacagacgtccttgtctgaaaaaagtcctttgttctagggcttatcaaccctgacaattctattatcggacatagttataggatgtttagcagatttttaaaaaaatatcgtattttttcatgatgttgatcctaatttgaacaattctataaaaacaaaagctgctgatctatcatcagcagctttatcgttttatgaatatcagtattgcttgatatcaaacattaagatattttggtacaccacataatccttcttacttgtaaaaggccctttattatgctcatcattgatttcatagaagttcatcccaattccaaaacttctctctttataccagtttagaaaatcgttaatttctttcattgaaagcaaataatccttttgcaacccgtttatcatggtaattgaaagtataccttttgttacttcttcacctggctttgttccgtcctgatctttcggttcttcggttgtgccatcactaggctttgtcccgtcctgatcttttggttcttcagttgtgccatcactaggctttgtcccgtcctgatcttttggttcttctgctgtgccatcacctggctttgtcccgtcctgatctttcggttcttctgctgtgccatcacctggctttgtcccgtcctgatcttttggttcttctgctgaaccatcgtctggctttgtttcaccttcagcaatttgcaagtcttttaatgagatagagattactgatttgtaatcacttttaatcgattttgaatgataatcttgcttgaaatttcgtccacctatgatatatatggtatcctcaatcgttacagcacttgaacctactctagcttcaggtaaattgatcgagcttcttttcacagaattcgttttagcatcataaaactgtgtgtatggtgataatagactggatctgtcgtcatactgtcctccagccataaacaatttcacctgatatgtcgtaaatgcagcccctagttgataaaaatttaactttgatttcgtttgtacccattgatttgtttcaatgttatattcatatacttgggcattatggagattactaactgttctttctccacctgtggcataaatcttgttgttaatgacttctgacatagacataccagtaagttgctgaggaaacatttttaattgttgccatgtatccgtttttgtatcataactataaaaattatgttcttgataaggacttttattcgttgcaagaatataaatcttatcatttacaacactcgcgcttatatccccttttgtcacagctaggtttggtatattaattggtgtttctgaccatgtatcggattctacatcataaatatcaattgtttttgtgctatcttgatatgctcctccaatgacatatatttttttccctatcgccactgccgcactatctgttctttctcttggcatttcagcttttgaactccactcatttttgtcaggatcatacatgtaggtatttttattactatgtgatttttcactacttcccccaaaaacaaaaatcttcccatctactactacggaacttgaatgaagtctctcttccggtaaatccgctcgcttcgtccagccatttgcctcagctgcatcagcttttaacggatgaattgtgaccatcataaaaatggtcaaaagcactagaaataatccttttttcatcatttttttcctccatatcttaaatagccctcctcttatcgacatatttgtaataaaatttaatttttatcactgtttactagaatcagcatttcctgttatttaccttcacacatacatcaccggcgtcgatattttaataatcttcccgcctcgacgataaaatcttgggacgcggcggcttagggtggcgatgacttcgtagttgattgtattgagcatttcagcgatttcatcgacagaaatttctccgcccttttgacgtccgtatatgacgacttcctcgccttgctttgctttcatttctcctaaactgatcatcgtcatatccattgtgactcggccagcaatcggcattcgttctccgcggaaaagcataaatccccgatttgataaagcacgtgagtacccatctgcgtaaccgattggtatggtggcaataacttcatcaggctttgctacatacgttgccccatagctgacggtccttggctttgtgaccatttccttcacgaacgcaattctcgcttttaaactgagagccggctctagctgaacagcgtctaagctttcaatgtattgcgagggatacagtccataaagtccgatgcctagccgaatcatatcggcgctaaattcaggaaatgcgatagcagccgctgtattgttcatatgtacggtcggcagcttaattccttgttttttcaaaaagcgaagaaaatcaataaaaatactgtgctgcagcagcgtgaaatcaggatcaggctcatccgcagtggagaaatgcgtaaaaattccgtcccatctaaggtttccactcttttcgagtgcctccactacgcctaaaagctcttccttcgttcgtacacctaatcgtcccatccctgtgtcgacattgacatgaatcccaagacggtgctgactttcttcttctgctaagatctcatttgcttcaacaatccagtcttcacgaaggccagatagatcaattctccaggccgtagcccttttcacacagtcgagcggagtaaacccaagaaccaaaatcggcgcttcaatttttgctcttcgcagcacaatgccttcctccaagctagcaactgcaagctccgtcgcaccgctttctagtgcctgccgagctacctccactgagccatgtccataagcattcgccttcacaacagccatgatcttacttttcctcggaatatgcgcttgaatggcttcgatatttcttttaatcgcatcaatattgacttcgatccagacttccctgcatagctttttcatttatttttcctcctcatcacatgagcgttctttctatatccatgttcgcttttgtgtctagtctatctttattcatttttgagaaaaacattcagctacaatgactgaacctgctttgtcttgttgcacataaaaaaagaaaccacatcaactgtgatttcttctctatgtgcgatgatattcaatttcatccgcagatttcatcattgcatcaatatcatgataaatctcctgcaaattttcccgttcagctaagtattgagcattgcttttatgaacaggcacatcaaattgcaagaagttgatcgtgatcgttgatgactctcggtcattcattattaatcttaattcaagcgttgagacctcttctttatcatctctctcagctgaagcaatcggcaccccatcttctaacatcacaacttgtttcaaatctttcaaggatagctcagttactgcaaatctatttttactagttgacccatcaggctgatgttcaataaagcgcattttctttaactcatcatcaatcgcaaatcccttatcaacttgctctgagaagaaataggtagatgcttgaaacccatcttcgtgaaaaagcatcatcattttgtccattaatatgtttggatcattctgttcttttcgcctttctaatctaccggcaataaataaaatgaccattcctccgatgatgctgagagccgttaccaatccattccctacatctacgaaaacagtaaaacctaaaatagcaatcataaaagcaatgataatgcctatgatgaatatcacacaatgctcctcctatcatgacccttcatgaatggtttagccatagtatagcatttgaagtaaggcgatttaagaatatttatatgaagaaaacagaccatacagatctgctttcccattgaacttcattcaagtgtttaaaagataggcagtaagaattcacacacgccttcttcttctctatatctctccataatagatgcctgacgcatgttcaattgattgttttggatcatttgaggcaattgactccaaaacaaattcactttttcggttgtatgtgtcactgtaaacacagcatactttcccccttcaaaatgtccagtctgaaccatttgatcttttgagaaaactctatttgtcatcaacatgaggtcgtatctgcatttttctggtgaaattttcccaggatcatcttgaggaacaccatatataccaaacccctttaattcatcaattaattgatgttgattgacccattttttaaatctcttcatcatctctacagtttctttgctgccatatggtcctatatttctcatatacaccattttcatattcgttaacatttcaattttgtaattcatgatttccctccaactcttattggaagattggccaatcattccttacatccaacggtaacatcctttaaaatataatacagcaggttattaaaaataattgaattatgttggaaaaatattcactggaattgcgatttagatcataaattaagtcatctcatcatctctttaaatagcatatcccatttttaaaaataaaaaagaacggtctttagccgctcactggtttattgattttcctttgaagatttagcaaagagaagggtaacaatcaaatagataattgttccgaaaaacagaccatttaacaagctgataaacaacatcttacaaaccaggccaacataataagacactggtgtccctggaaacacagccatattgaacagactaatcataaaggttaaagcaaaaaatataatgaaaatctttcgaaatactgttgattttaacattgtcatttcacttcctcctcagtatgttttctatggagaaactattctttgttcatagcgtatattccgttttatagtaaaaagcccttaaagggctttttacttaagcagtataaccaatacttgcagtgtgacctctcctagcttcatcatgacttgctgtcacttcagacgtaaaataaccaacaacacttatgacactaatcatcacgaataccactgataacgttttaaatttcatactgacagtccccccgctttacttgagtttggaaataaagaatcttttcatagaaatgcatcgcgttgtctttatctcccatttcattataatattttgcagcatcttttgctaaatcttcgaggtcaggatacattgactttacttctaacaattccattattttttccaactgctcaaaattgttgtcaatgtatagagatcttaaaaacttgaatatcaataatagaacatggtctttcagcttttcagatagttctataccgttatttaatgcatatgtacctaagtcctgttctttctttttgaagtaggcttttgacaacataatgagcggatctaagattctatttaaatgctcgtatccctgctctttaaatgctcgaattgaatcattaaaatgagtaatcgcttgtgctaattctttgttatgaaaataactcaaccctaaattataaagtgctgatccttttaatcgttttgttgagttgtcggcggctttttctagtgcgtgttgaaaatggggtatcgctttttcggggcagcccatatcgatatagtttaatccaatcacaaaagaacattgaatttctctcactgtgtatgtatctttttctctgtaacagtctatcgcctgtgcaatatggtgcatcgacatgtgggtttgtttcatgtggtaataaatttctgccatcttgtaattgaactcggcacgttcaatatcgtcgctgacaagagacagctttttttctgcccgcttatagaaggtaatcgcatttaggtattcatagttttcaaattcatacatgccgtagaaaaaattgaaataatactcgagcaatcctgttaatttctcttgatcccttttgatcttcagtgcgagttccctaaagttcgcccgctctttcccattttctaaaggattcaagtaatcaagcattaatttatgtctgaactccataagtgagaaatacaataataaatcttgattttcttccatatgatcaagcattgatttgatttcctctttatatgcttcggcgtccggtacgttaaatcgttgaatgtgataataccattcattgattttcaaaccgacgtgagaagaaagcactttctccatcagcccttaccccttcctctattttccctataatgacatatattatcatttcataaatcgtccggcaccgaaaagaaaccgcaaaagaacaaaaaaagcttctttaaagaagacctctcctcctgtactctctaatgatacattcaggtctacatctagtatatccttcacgtcatacttgttttaatcgtttccatttacgaatttgagtacggaaatttttaaaaggggcaacggtattcacatgaataaatttataaactggccagacagcctttgctgtagcgtcatccgcccattttcgttgatgaggttcaaacacttcttcttcactcatacgatctaacatattacaaatagttaaaacattctgtttgagctgagctcttaatgcgacaagtgattgacaagcatacttctcattaaaaagagaatataatgcgccaagctgattccatttataaccttctgctggcgtatggacaaccattccttcagtttcgtcttgctcccattgaagtagcagggtagtccagccaacttgataggccaaattttctgcaggagttcggattacatcctctatttgatcatctttcatttcttctgggatcatatcgaattcttcatcgtattgattgtacgatttcatgattgcttgctttaaaacatcttttgactcatagcttgtcatatgactcacctctaattctttttgtgcaaatttttctcggaacatatcttgcaaaagtacaaaaaagtaactgtagctcatgatactgaaattattcttaatcgagcgaaaaagcaatagctcaataaagtaaagctataaaagcggctgcgaaaaaagaagacactctttacgttccatcataaacaaacacccagtatctctccccaggctccccttcttctacaacagccttccagcctcttttttgataaaaagtcaaagcgttgtgattgtcagagacacatttgagtgtgaccggtgttccgagcactttgatagcatgtttgagcagcagatcaccagccccttgaccagcagcttttggatgcacaaacaagagatgaataaaacgatctggtacatagagcgagatgaatccgaggattttgttgttgtcttcagctaagaaaatttgttcttccagcgtatcttgatcaaagtcttgcagattgatttcttctgtattaagccagtgaaagctctgacggcgggatgctaaatagatttgtcttaattgtggataatcttctatgcttgcttctctaatcaacatcgcatcatcccctatgttttttaaatgttatgtcgcctctagaatgtgttttgcctgtgttctgcctgccaataacaattgatcactgaactgcgaatcattgacagctcgtgcaagagcaattgtaccaatcatgctgcttactagtgcgtaactcttagagagatctatgtttccagcatcagctataaacgccataaatcgtttcagttcatcagtataaactttccgtacctcttgcgataattgagaaatctcccctgcaagcgcaggcagtatacagccgacctccgtctgatcacggtgaacggaacttaaatagaattcaatgatcgtctgaattcgaggctggtctgctttcttgtctgcaacactttgcagcagctttatcgtatcagtaatagcaaaatgaaaagcctctatcaccaactgatccttgttcttaaagtgagcgtaaaaccctccatgagttagacctgcccctttcataatgaatggcaaactgatattacgaacgccatttgttcgaaatgctcgtgcagcacttgcaatgatttgctctctcacttttgacttatgacctttcggataaggcatcttcttactccctccttcactttaactcttgctaagtgtgtttatcaaaatattataatcatcatattttcgagtgtcaaattgactaaaatccatctttcctcacttagatgggattgactccaccaaaatatgatggatataatatattatgatcatcatattttgaagatggaggttcaagaaatgattcatttagaaacagtagatacattagtgattggatcaggtccgggaggctacgtggcggcattacgttcagctcacctcggcatgaaaacagcgattgtagagcgtgatcaattaggtggagtgtgtacccatgtaggctgtatcccatctaaagcactaatagcagaagcagagcggttcaaactccgcacacaatggggtggttgtcaagaaggcggctctttcaatgaagctcaagcgttcaaaaaagctgttgtggaaaaacaagctggaggcgtccaatttttgttaaagtcagcaggatttaccattctggaaggcgaggcaaatttgatcgatcagcatacagcggtaattcaacatgcggaaaaaggtaaaaagcgaatcaacttcaaacacctaatactagcaactggttcccgtccaattgaaatgagatcactccctttcgggggtcgtatattgtcttcaactgaggccctatcccttcctaaaattccgaaaagccttgtcgtagttgggggtggttatattggggttgaacttggacagatgtttgcaagatttggagcaaacgtcaccattttggaaggcggcaatcaagtattgcctggctttgaaagtgaacttgtttcgcctgttgttcgacaattgaaagaagataacatcaccctgattacaggagcaaacgtcacagatgccaagcagcatatgagcggaattgatcttcattatgagaaacagaaagaaagctacacggtgaaagcggaatatgctctgattactgtcggaagaaaaccaaatacagatggtacattaggtcttgattctatcgggttgtctattaccccacacggactgattgaaattgatgaacaatgcagaacatctattccgcacatatatgcccttggtgatatcaccaagggtcctgctctggctcataaagcttcctatgaagcgaaggtggcagctgaagcaatcgctgggaaaccttcgataatagattataaagcaatcccacttgttgtgttttcaagcccagaattggcgagtgtcggactgagcgaaacagattgcaagcaacaatccattccgactgtcattggaaaatcaatgttctccattaatggtcgagcgctggcactaaaagaaccagaaggatttgtgaagattgtagcccatgccgaatctggccttattttaggagcacaaatcgcaggtacagaagcatctactcttatatcagaactttctctctctattgaagttggtgctacagtagaagatttaacaatgacgattcatcctcacccaacattaggtgaaataatcatggaagctgcagaaatggccacccgtaaagttgaaaaatatctatcacgataattgtttaatgtgtagtttctacaattgagcaaaataatcgccatagcctatttatttaggaataggctatggcgatgtcaaatgagtattgatattaaaacgtcggtcaattgatcattaattggattctacttcgcgctttttaccgagattcatagataactgaacgccaatcatcagcatgacgatgacaagcattgccacaatagaagcataaaaatgtccgcttagatcgaaaactaagccaatgaaaaacggaccgaatcctcccatgatatacccgcccatctgcgacatggcggaccaagttccggcttcctctggagtacgcgtctctataatcggtagcatgagcgctaaaggaaataatccacctgcccccatacctaggaaaatgacagctggcaagattggcattggcaaaagaagaaagatgagaccaatcagctcagacagactgcataagatgagaaataatttcggttttcctaatcgagtaacgaccgctggaacgagtagtgccaccggaatctgaatgagtgtaaatatggtcagcagcatggcagcatattgcggactgtttccgaaactaagagcaatcggtgaaatccatgccgtcaaagaataaaacatgctggacataaagccaaaaaacaaggtaaattgaatcgcctttttgtttcgcagcggcaattttagcggcaaggtaacaaaatcactctgctcatttttgcgagcaatacctacccagagaataagcgcgatcacccctagaatagcccagcaagacaatgcaaacggaagatggtgactgcgcaagtaaatcggaatggtgaagccggaagcaagtgctgcacctattgtcatcgaaatggaatacacactgacgataccaggatttctcgggaaatactttttaataaaactagacaataaaggacccgcgaagctaatccctacccctcctgcaaatgcagtcataagcaggatagcgactgattggcttgtaccccgcaacgctgtagcgatcgtgatgagaagaatcgagaaaaaaagcgttctctctaaaccaaatcgccggctgagtgtcgtcgcaacgggagcaaatacccccatacaaaggacaggtaaagtggttaaaagacttgctgtcagtgcgttcacaccaagctctgattggatcatactcatcatagaagcgacggacgtaatgattgggcgcaagtttaatgcagctaaaaataaagcggctaaataaaatatttttttcatcaatgcacttcttcctctctcaacttgttgaagttactttgagtataaatccgccgcattcattgatcaatacaataattcgtattatgatgatagtaaaaaactatgattaatgaaaggatgacaaatggatactcggcatattacatatttcatggcagtattcgatcatttacatttcacaaaagctgctgagcaattagggatatcacagcctacattaagccagcagattcggttgcttgaagcagaagttgggatgccgctctttgatcgaatcggcaaaaaagtcgttgcaaccgaagcgggttctctgctttatcaatatgggatgaaaatgcttcaagctgaaagagatgcaaaaaatgcgatgaaagaactattatctgaaaaacgaggaaacgttcgacttgccgttctcccctccgatcttgactttcagcttgttccgctttttgtagaatttaaaacactttatcccgaaaccaatttgaaagcatattcaacgatcttcgttcgtgaagaagtactgtcgcataaagtggatctcggcattgggctgcgagggcctgcggataagcggctcattcaaattccacttggaagtgagccctacgaattatttgctcattcagaaagtgaactagcccaaaaaagtgaagtgacattggaagagctgacgcagtatgctttggtcatgtatccgaagggatatctaggaagagatttagtagatgacgtatgtaaagaacagggtgttgaactagacactgtcatggaagttggttccgcatcttcattattgcagctggttgaagccggcatcggtgcaaccattcagccgcgaggattgctgcaacaacatgcgacatggtcaaatattgtgtcgattcctattgctgatccggcacctgttcgtcacttagaattaacttattatgcagatcgatttgtcagtaaagcacagcagcagctatcggagtggctgattgacttttttaaatcaaaaacaaatgaaaaatgaggataaaacatgaagaatgcaaacagcgtatttacaagaacaaaccggatagtaattcgtcaatttgatctacaagatattgaggcattttatcagtatcgagcaaacccctctattgcaacatatcaatcctgggaaaactatacgtatgaacaagctgaatcatttgttcagcaacaaatgacgcaaacacctaatcaaccagggacatggtttcaatacgccattgccttttctgaatccaatcaactgataggagattgcgccattcatacacttgaaagtgagcctagaatcgtcgaaatcggatttacactcgcacctgaatttcaaggaaaaggctatattcacgaagccttgagttcaatgatcgaatatattttcactacactgaacaagcataaaatcattgcctttactgatgtgcgcaatgaaaaatctattcgagtgctggaacgtttagacatgagacgcgaaggacatttgcttcaaaatgatatgtcaaagggacattgggttgatgaatatcaatatgcgattattcaatcggagtgggccgcttaagcggcattaaaagacgctcttgataaaccttctatatacatatagaacttttctataacgctcagcatgctttctttttttataatagaaaaaaaagaaatgtggtggcgtatatgtcttcaacgatcggaatcatgggcgggatgggtcctttagcaacggttgatctgatgaaaaaaatcatttcacatactccagcgataaaagatcaggatcatcttcatgtgattgctgataattatccccaaattcctgatagaaccaatgccatatttgggaaaggcgaagatcctacagaatatatgattgcatcagctaaaagattagaacgcgcaggagcggactttattctgattgcatgcaataccgctcacttctttttagaaaacgtacaacaatccactcatatccctatcatgaatatgccattagaaaccgcaaattacctaaacaaacatcactatacgtctgtgggcttactatgtactgatggcacattaaaaaccaagctctaccaaaaagcttgtgctcatcacaagattgacgtcatgaccccaagtgaagagcttcagaaaaatgtcatgaatgggatatatgcagtgaaagcagggaaattgagcaaaggcgaaagtgaactggcattagcttcagaaattttaatcaaccaaggagctgaagccatcattgccggctgtacagaaatccctttagttctaaggccaaccaaagctgtgaaagtgattgaccctactgtcattttggcgaaagaagctgtaaaattggtgtatgagcttgaaaagctaaacatttaaagaacgtcatataaggggataacatgaatattgagaatatagaagcgtttatttatgtatgccagctaggcagtatcaataaagctgcagaagcactctatttaacccagccttctgtttcggcacgtattcaatcgttagaaaaggaattagacctgaaattatttgatagacagagaaataaattatctctgacggaaaaaggtgaacagttttacccgcatgccaaaaaaattctccattcttatcaagaagcaaagcatagtctcaaacaaacgatgatcccttatgaattgacaattggatgcgcatcctctatttccaataatctattgcctaacatattgcccgccctaaaagaaaaatacgaaaacctgaaagtgaaaattgtaacaggacattcaaaggatgttgtccaaaaagtgattaacaaccatgtagactttggcattgtcaggactgaaacgcatcctcaaattgaatcactcccaattttcagcgatccaattgggctgttcgtcccaactcatcacccgcttgccggccttgacaacatcaatatgaaagaactagaagaacagccttttattttctttgactatgggtcatttgattggttgatgcttcaccgattatttcaaaaaaacaacatcacaccgaacatttccattgaggttgatcatatggaaaccgcaaagaacttagtgctgcaaggaatgggactatcgtttctacctcatcattgtgtgagaaatgaggtagaacaaggaaccttaaaacaaatttcaatcgatccatccatcaatttcaacatcaatatcgagttcatttataaaaaaggaaaatccaaatccgttttcattgatcaactcaaacagttttttcatgatttagattaaaaaagccctttttaggggctttttttggatttattctgattattagctttcgtttgccaacatgtatgctgcagtttcatgcatatcttttaatcctgatctctgagcgtactcggccacagtgatcgcacttgtagtcagaagttctattatatgttcatccattcctgaccaagttcttccgcctgctttttcatacgcatggataagttttgttaatccttctttcccaaacagaagttgatgtgacaaaaagtctgcagatacatcaccaatccccagttcagaccaatcaatcacacccttaacacattgattttcatcaatcagaatgtggccaggatgtaaatctccatgcttcacccccacgaaaggcggccataaagaatcttttgctagccattcttgccagcgctcccataaaccgctgttaatggtgtattgcgatttgacacgttccattcgctgtttcattgattctcttaattcatgagcactgagcatctccacaccgatcgttttaaaaggctgttgatctaaggaatgtacattcgctaaaacgtttcctaatgattcataataagcttgcggtacattcgttgggtcaaaactccacacataagattgctgttccacatcaatactagccgccggtaccccctctaattgtttataagcaatcagactttctgtaaagatagaccaattagggacctgaaagtgaacctgcttactcatatgatctaatgtctttttttcttgtaaagtatgtttctttgattcaggtctgcgaggcattcttaatatccattgatcgccatgtatatcttcgacgtgtgcgacacggaaatccacacctgattcatttattttgatggtactctctaaaatctctaatccgtgatgtttggctaactgctttaattccagtctattcatatccattcctccaattgctcatttagtcatgatcaataggcgtcaagaatatcatcacaaaacccacaaacaggctactttctgtggtcagagtaaacaaagctagacttataattttctttgcatcataaaaaacatacaaaaaaaagacagaacgattaactgcctcttttctagtgaaattgcatactttcccgctgaagatcattaaaaatgtgcagactaccccgtttactccgttttgatgaaaacagagcctttgaacatatgaaattactaattgttcaaagtttgttggcgtaatcttcctgcatgcatcatctttaaccatcctcctctttgtcatataaagttactatactttatttaaatatgactttcaataagatgacaaaataaaggatttaaaaaaaccatatatttcattaaattacataaaatgataattgtgtttattcatgttatgatatggttattaattcttttgtctaataatttatgaaactcaaatgtagctaagtcatttaaagggagaattggtatgactcatttagaattcgcattcggcttgcttccagtcagtatgatcatcgcttcttttatcgtcacattgattgtacaaaagatttatttcatgccagttgtgagctttatcattttactcatcctgacatttacactttttaatgtctctttcttaggctgggtagttgtctacactttaggctcaatcattgcttcatatttagcgttattcatcatgaaaattttaaataaaaagaggtcttaaatacatttaaaaagccctttacaggggcttttcttctttcactatcgtttttccactggataaatgtcttctcccaaaaaagcggtattaggatctccactcttttctaaaaactcagccatttcttgcagctcttgattgatacggttatttcttggcatatccgggtttaacagaaggatggagtgaatcgttgtggctgtttcatacaaaacatgttgatcgtttatctgttggatgcatagtttcatacgattgaaaaaccattcgatctcttctgtttcttccatcggataatgtgccattttgaatagattctgctgacgaaggtcctgcctctcaaatatgtgttcaagctcttctttactgacatataaatcagaatcttcctccttaatctctactacttcgaccatcgcatcttcagctgtatataacttctcaataaaatcatcgaaagtttctgccagcttaaaatctacttccagctctaaatcaaaatagtgaatagaaggatgttccttcgtttctcgataatccatggcgatccatgtatcttcttctccgctgatgatcacaagtccctcaggcagatccaattcattacttaaccgaagactattcatgttgccatcatctttggcgattcctcttaaatggtcaaattgaacatgatcctcagcccatgaattcggctgttcggttggaaaagcattacgaactgtaaacccgccattccattctaaaatgagctttttgtatgtatcaggtaaaatgactccaagtgtaccctctgcttcatgaatttgttcctcatctatcttttttaacgtaaaaggactctcttcctctttctcccagaatgatttcaaagtgggtgcctcctcgtatctattgagataagtataacattgaccaactgttcatttgctcattctacttcataaaaaaacagactcttaaagtctgttttaatcttgtctatacgttttcagaggttgtatttcgatcaatcatagtcgtgtttcgatttgatttttgttcctccattgttgtattccgaattgattttgtttcaatgatttttaaagtttctgctgttgaaacacttaacaatacaatggataaaatgattagtaattttttaataatcatacagacactctcctttttgaatatcattttgagccttaagagcctttctataatattcggtagctttttcaaagtccccttttttttcataaaataacccgacactttgagcaaatgcttccacatagacatgtagtttcttttcttcaaaaatatcaaacacttctttcaaagcttgttcatcagtatccatataaatagcttttaatgctttaaataacaagacacttagcgaatcatttacctttgaggaatatataagtccatcttcaacgagcagatccgcttcatcagtttgattagacttgtacagcgaccaacacaaactaaatagagtgattggctttatgtcacttttttccgaagaaatgacatctaacacttctttataatgctttattgcctctgtatactttgattgcctatcatatgtattaccaatatttaataatgtttttgctactaaacgttgatcgtttgcgcccacagcaattgaataagcagtctttaaatgttgcaacgacttttcatatctcatgaaatcatcataatttcctgctatgacaattagactttgaatttgacgaactctatactgttcatgttctttataaatatctagagcctttatgatgtgatgcatagacacatgcgtttgcttcataatatagtaagcttcagccaccttgaagtgaaactccgcttgctcaatatcatcgacaaccagtgcgagctgcctctcagcgatcttgtaatattgaatggcctgtatgtattctttcttactaaattcatgcattcctctaaaaaaggcattgtaatattgcaacataccggaaagttgatgattagaattctcaattttatcaaccaaatcagaaacagaaggtgatcttttttctgaaggcttgatataatcaagcataagctgatgacgaaagcacatcaattgataataaatgagtaaatcttgatcttcttccatccgttcaatttcttgttctacctcagctttcaaaatctctgcatctggaacgctgaattgccgaatcattttataccattcatttattttcacacctacatgtgaagaaagaactttctccatcccttattccccttccaccaaaatcccttatatgacattcattatcacatacagtaatttacaaagcaccgaaaagaaaccgcaaaaagaacgattgttacatcaataaacctttgacacaattcatgatcatcacaaaacaaaaaggcagactcatttcagtctgccttcatcttctagatttccatgagaacaccttttgtcttcaggtaatttgcaatgaatcatttaaccactcttcacaatgttcaataagccacctcaaatattccacatattgaccgacgtgatagccatcacaaacagcatgatgtacttgaatcgcaacgggcaaaatgattttcccttcttccactttaaatttgcctatcgtaaatattggcagtaaataagcttcatctgtagatacagtaaggttaaaagaagtaaaatcaatccacggtagacttgaaatattgaacatgttttctggcatatgaggtttcggaaataggctgctgcttttgctatatgtttcaatgtcggctacacagcttttataaaactgagcaaagttttcatcataaggcgtccaaatacttgaaaacgtctttgtttctttatttagaattgtataactaggatggagaatctcccagtaaccaagctcatctttcacttgatccatccgaaactcaggaattttttgcacagctcttgctaacaaataaatttgcacaggatatacttttagctttttttcttttaatattgcatgtaatttcgtgatgtctagattgaccaccaagctatatgagcatcgggttaatgtcatataatgatgaaagtgctcttttcgcgggtaattttcgtctatttgttgaaacattttttatctcctcctgaatttgatttactgtattcaggaggaaactttatctgttttcaccaccacaatcatcctttcaaaagatatgtcatgtttctgtctattcaaagtctaccatgagctttgcttacgataaagcctgcagcaactcttcgtaagtcatcttgcccaacgtgaatttttctagtgctatatatgttttctccgctgaggtattcattctattatgacattcattcactagctcatgttcatttggtaatggttcatgtatatgttgtgttcttcgaaatgcttcatagtatcttataccaaatattctttgggacatcgcattgatgtgaattccgtccggattagatataaggcctttcgcagtaacataataacaattttcatgatgttgtgcatatttttgtagttcctcattaatacgttgatattccacacaccctgcgccaaatgctgcctttcccaagaaatcgcccaaacctcctatcaaaagcggaatgttagggacagataattcagttcttagttcatgaaataatcttcgtattttttcatcgtattctttgtatttcccatcttggctgtcactttctccttgatgccataatatcccggccaattcgctatcttcctttgcaaatttagcttcatttattgcatgacgaaataatgccccatctcgtgaccactcatcaatggaactgccaccttcagcacatggaataagaccaattttttctccctcatgatccttacaccaagtctccgcgaaggaagcggccagtcctacaccagcgaccggcctatcaaaatgaataggttcagtcatcatctgccatcttccatttcgcagcatcatgattctttcattataaattggcggcacttcatgcttaaagcctcgacccgccatattagattgtccaattagtaaaaatgacttcatacctttccccctctaaatattttatcaaatatatatctacctgaacgttatcagtttacccttgcgctgtgatttctagaatttcaatcatctcttgaaattcccttaaaatctattacttctttctcgactcataaacataattcaaaccaaaagcaatctcttttaatatatcaatgaaaatgtgaatggccgctcctaggtgtttgtctttcctataaacgatccctacacttctaataagattagcattatttataggaataatctttaatcgaggttcgtttagatattcaagataaggagttggtaagaccgttatccctatgccatctaccaccatattaattaatgactgcatagttgttacttcaaaaatagggtcgggtagaaaaccaatatctttacaacttttgttgattaactgtctgatataaaattgctcaggaaacaaaattgaagcggtttcttctaatacttctaaccccaacttttcactttgtgcaaggggatgtttaacaggtactgcaaaagccatatcttccatgtataaagagattgtttcaaattcatccccttccattggtaaaaagacaattcctaagtccactctattttctattaagtgtttttgaatatccccagtacgcagacctagtacagaaattttaacagctgggtattgctgatgaaatttaaatagtgccggtggaataagatagttctcgactgttagtaatgtcccaattgagatcgatcctctttgaagtccattcaattcattgatcgatatttttgcttgttcaatttcgtgaaaaatattgcgagtatattttaataggagttttcctgattcagtaagagtcgttttcttaccaatacggtcaaacaaaggtgttccaatttcatgctctaaaagtttgatttgctggcttaaagatggttgagatattccaaccttttctgcagcttttgtaaaatgcagttcttgacacattgcataaaaatactctaattgttttaattccattcttcgactcctaattagaaattttcacaagtaccaactttatgatttttaaatatcaacatctaatatacattattatacaaataaaaccataggtacaaactatagttattatataaataattgaattgttctataaaaataagtgtcttagactattacatgaaggctagatttacatgcacaaaggaatccttcaaaccgtgtaaaggaggtcagtcgatataacgagaacaagtaacattttttataaatgataaaaattttaatgttggaggttaaaaaatgaagaatttaaatgtcgcaatcccaaccccctttcatgaagatgaaagtctgtacttggatggatttaaaccaatcgttgaatatttagctgaaaatggtattgattcactactcgtatctgcaactacaggtgaacaaaactcaatgagtattgaagaaaggatacaaattattgatttttttaatcagcaagactttaaacatgttgaactaatgtttggtgtatcagctacaacgacaaaaaatgcattaaaattgattgaaagtctcgatgattcagttttcgactcgattctcattcaatttcctccttatatccgaccaactcaggaacaagcgatgtcttacatgaatgaattgttagagcaaaccacaaaacatgttgttctttataataatcctttgcgcacagggtttgaattgagtgctgactcatttcacactcttatgaatcaaaaacactctcatttggttgggatgaaagaagagagtgatgtaagacgcctgaaaaatacaactttaccagatgactttatcatgttcgctggaggggacgtaaaccttactgaaaaaatattaaacggatgtaacgggctttctagtatggtaggaaatgtttatccaaaagagattcaaacattttttagtgacttagttgcaaataagcctgtgaatcttcaaaaaataaatcaattaatcgatgaggtgacacgtggacacgcgattgtcaatattaaaaaccattacaatgctttaggcataaaggtaggtaggtgtcgttctcccattcgataattattaattcattgcaagcaggttcgaatcatttaatccagcttgccccaattcgttataaaaaatttggaggggtctatagctgccatgagtattccacaaacggagcaaaagaaaagatcgagtatgcagacaaataaaaagatattaactgttgttggtgttattctaattgcagcaaatcttagggccccaattacatcagtcggtccagtattatcttccattcgtgatcatcttggtatctctaacacattagctggtacaatccctacagccattttactcacattcgcattgttttctccttttgcccccaagatcactcgccgtttcagcatggaattcatactgtttatgtcgataacattattattagttggaattggaatacgttcttttggtagagtggacacgttatttataggaaccattataatcggttcttcaatcgcgatttgtaatgttttattacctagcttcattaaacatcattttgcaaccaaattaggttcgatgactggcctatatgctgtttctatgaatttatttggcgctattggttcagggattagcgcccccatttcttcatcattaggtttcggatggtcaggcttcctggggtgctggggaatcttaactcttcttaccatgatattttgggtaccaaaactaaggaacaaccaagaatctttggatttttttcgaaaagagaataagaaaagacctatcagcctttggcgttctaagctagcgtggaatgttacattgtttatggggactcagtccttcgtatttttcacagtcatttcatggatacctgaaattcttgaaactaaagggttaaatgctaatgaaagtggatggatgctatcattgatgcaactttcaatgcttcctgttacatttattgtacctattttagctggacgttttagcaaacaacagatattagtatggatttcatttctcttgcttgttgttggcttaatgggctttttatttggcgtgtcattccttatacccctgtggatgataatgattgggattggcattggaatggcctttagcttagccatgatgttttttagtttacgcaccaaaaatacacaagaagcagcagaattatctggtatggcacagtctttaggttatctattagcagctttagggcctattttattcggctggttacatgacattacttatcaatggactgttcccctgttcatgctaatcttcatttcagtcattattttaattactggtgtgaattctggtaagaacgtatatgttacttctgctacataaatggtaacattcattaagaatctttatgatacttgaatcgtaaagatttcccaattcgtcccttttcaaaaaaaataaaaacaaatatctgttgtcgaaaaaaaaccttgcttagcacgggtttcaacgtttattccgactggactcgaaccagcgacctctcccctgtcaaggtgaaagaccttatccgaagctaccagatgttctcttaaaaagactgatttaataaggtacgatgggcctttctaataaaaaatgtgcacttctgaagaaaactgaaagttgcaaaataaaaatttttttctaaattaatctctcccatcttcgggaaatgaaatataaattctttatgatataattcaatatcagtttaaaaatgcctttttgaactttaacaagcgatccagattacatcacaagaaacttttataaaacgaatttttaggaggtttacattagtggacagttcccccaatgaattgaagcttatcgttccaacaggatgtgacaatgctcccaggaaacaaatagtcattgattttacagtagctatattaacgcagcaaactgaagttattaaggaatatgcggttgaatctattatctggtatcagttaaagggtaatacaaagcttgaagggcgaaatgccttaatctccactttgtacaaagaggacagagaaatcgttggcaaccttgaaatttaccaagtcataacacacggaaaatttgcttcaattaacggtgtaatgttattagcgaatggtttaaaaattgatttctgtgatgtatatatttttagtagtgctgcaaagtctggaaagataaaggaaataaaatcatataggatttaaacattactggtccatttattaggtgactcaaaaggcgttgtgatacaaattccatacgctttttagatataataagtgtaaaaacaccctaacaaaagtaagggtgtcttttagcgaggtatttattatttatagtttttttgtcctccatagcgctccattagctccagcacctacaattacgcttcggcatggccagagttaaaaacaccccctccaattttagagcccaaaatggcttctacataaatccttgttatgtatgttttttattgatgcaaatgctttagatagatatttaacaatatgttagaaagtttacttgttcgatgttacttaatcaacaagcaaaaaaatccccttcctacaatggaaaattcctttaatttttgaaaggaatagtttaattgagaaaaacaaattggtttctgtctatgtttataactgctttaatctcatttgtaattcaatcgggattaagtaagttcgacgtgattaacacgtcaaatctttggctagatttggtcagttggatagtaatattctttgtcgtattcattggcgttgaaacgtcttttagaacgatcaataaaatgaaacattgaaccgaatatagacaaacaaaaaagcccctttagaaagggactttgggtatattaacgtaatagttgaagtacgttttgtggctgttgattcgcttgtgcaagcatagcttgagaagcttgagaaagaatgttgttcttagtgaactcactcatttcttttgccatgtcgacatcgcgaatacgagactcagcagcagttaagttttcagcagatgcccccaagttgttaatagtgtgctctagacggttttgtactgcaccaagttttccacgttgagcagatacttggttaatagctgcatcaacaatacttagttgagtatcaaaaccaacatcagtagcatcagctgcattatcagcaaattttctaacatcgatgtctttcaaagattgatttgcaacaattccatcagcgtctttaactcctaatgcatctgtgctcattttttcaatatgaactgaaatttgttgagttgcgttagcaccaatttggaacaccaaatcattaccagttgctgggactgcaggtgtacctgcatcatctggatcatctggatctcccggaattgctggagttcccggcgttccagctttaaacgtaccatctaataatttcttaccgttaaactctgtacggtttgagataccgtctacttcttcttgtagagctttaatctcatcttgaatagattgaagatcagactctttatcctgtgtaccagtatttccagcttgaacgactagttcacgaacacgttgaaggattgagtgagtttcagtcaatgcaccctcagctgtttggataagagagataccgtcctgtgcgtttttagatgccatttctaatccgcggatttggccacgcattttctcagagattgcaagacctgctgcgtcatctcctgcacggttgattttaagaccagaagaaagcttctccatgttcttttggctcgcaccgttgtttgcagacagacggtttaaagtgttaagtgctgcgatattgtggttaattctcatttcttattacctccgtgtaattttttagagcttatctgtaaagtccatttagatgagaagctcttccttagaattttcgatttctaaggcatgtgtatagtagtaacgcagagcatcttttggttctctaactttactaccttatgtaacatcagttatggcaataatcctgaaacctccttctatcaagcaaaatgattattcttgtcacttttacgagactagatactcgccataacaatgagtattatgttacctactatagacagaccttccacatattttagtttgtggaaattgttaatttcacaaattcgacacatttaacaaccagataaggatgataaaattcaatcaactacagttttatggatcgtatttctgcttggctacatcagaaaattcattatcaataaaagttcaaatgatcattgacagaataacaggactagttttagtaggttttgctgagactattatttacaaatccaaagcattaaattttgactacaagtagagttacaccatttaaaacataaaaaaacctctatcctataaaggacaggggtttttatgttttaatgtcttttgaagagttgttttttaatgtttaaaaaacaaaaaacccttgcttaacaagggtttcaacgatgattccgactggactcgaaccagcaactctcccttgtcaaggtgaataatcatccgaagtaactgatttccccctgaaaaagactgatttaataaagttctatgatgaggctttctgataaaaaatgtgcatttctgaagaaaactgaaagggttcgtccccataaaaaaacagacccttcatgttctgttttaattttgcctatacgttttgagatgttgtgtttcaatcagctgcaatcactgtaagagcaatcaacgtaaaaccctcctttaaagtcatacaaacaatccctctctgagttttgaattgtgtttctaataccttttgatcagcaaccgtagcttcttcaaatcgaccttgtttcccatactcatctgcatatactatctagcatgcttcagcataagcgaaacgctgtttctgctctaaatactgaaagacctcggcaagctgctcctcatttatattattaaaataaatcggtttataccattttaacaagtagaaatatctcatccttattttaatattggcttacgttaaacttgtgaaaaaaacacattcatgtataatacaattgatgtatgatacatgaattgtaggagggtaacctttttgaaaagagaagatgccttaaaactaagatcagatattaagaaaatgattataataactggggtttttgaatctcaaaatttgcccaatggaccatttgaaaaacctctaccaacttctcaaatgatggcgttagaggaactagaggtggaaaaattaactgtttggcaactatccaataaacttagattagagacttcaactgtgagtagattggtagataagttagtaaaaaaggggcttgtttatcgtgaagtaaatgaaaaaaatagaagagaactttttctgcacctcacagaaaaaggtcacacaactgttgaatacttaagagagcaatccattacattttatcaaaatattctcaataacttatcagaatcagaacaaaaaatagttgtggctggttttgaattatttattgattctatttctaagccttttgattagagtgaggtaaatcaaaacatttggagggtataatgagtttggattttgaacgtcctattattgaattaaaagagaaatttgatgaattaaagaaaataatgaaagaacatgatgtagatttatcttcagaaattcatatattagaaaaacgtttaaataaaatgcaagatgaaatttattctaatattacaccttttcaacgagttcaaattgcaaggctacgtaaccggcccacgacattggactacatacctttattgtttacaaactttctagaacttcatggtgatcgattatatggtgatgataaagcaatgataggtggtattgcaaaatttaaagggatgcccgttacgattattggtcatcaaagaggtagaagtacaaaggaaaatatagaaagaaattttggaatggcacatccagaaggttatagaaaagcgctaagacttatgaaacaagctgataaatttaatcgccctattattacatttattgatacaataggcgcctatccagggaaagggtctgaagaacgtggaatttctgaagcgatagctcgaaatctatttgaaatggctacacttaaagtgccaattgtttgtattgtaattggagaggcatcaagtggtggagctcttggcattagtgtcggtaaccatatccatatgttagagtattcatggtactcggtcatttcgccagaaggagcagcatctatcctatggaaggacgctaagtatgctccagaagctgctgaacatatgaaaatttcagcaaaagatttaaaacagttaggaattattgatgaaatcatccctgaaatgaaaggtggagcacaaaatgatataaaatcacaggcacaaatgattgaatctgtgatcgaatcatctctaaaaaaattgacaccattatcctcagaagagcttatacaacagcgatatgaaaagtatagacaaatagaaaatatttaaagtccgtattacatttaggaggattcttacaagatagttctaaatattttgtaagtaacctcttaaactgaatatgctgatactattaaaagatgtgtgatcggtatgaaaaaggatttcttccatcaatactttttctgaaggtcctcaaataattcctcataaaaaacagaccctgcatggtctgttttcattttgcctatatgttttgagattcttcatctctcagtcgccaagccatatctaaagcaaaataagtcaaaatgccatcgcatccggcgcgtttgaacgacattaatgattcttcaattacaacatttgcttcaagccaaccattctgaatagctgccatcaacattgaatcttctccattccttacctaatttccataaaaaacttaatattatatttattatcacatccaagaatttacaacgcaccgaaaagaaactgaaaaaagctcctgtaaaggagccttgtgatagttatagatttaatatgaaacttgtttataaaagtacatcattgaaaattatttataattgtacttaatgctttctttagtacaaccttatcatcctttgacaagttttgaagcgctgtcttgttcagctcaattgttgctgcttcaacttgatctctaatgactaaagatttttgagtagcctctactaaaatatttcttcgattgtttggatctattgtgcgttcaattaagtcagctttttgcattttatctaatattccagaaacggttgaggcttctaaatatacaagttctccaatttgtttaggagatagctggccctctctccatagacagttcaacacaccatattgagcgggtgtcaaatcacattcctctaaaagtttactaaagtacttgaacactttattttgactaacacttagtaaaaaatttatgcactctgataattccattttatctcccccacattgacttcacctataatatcatggtagttttttaattgaaatacttttggaccagaaatattttgttgtaatatatttttagagaggaagatacacgatggattcatttaaagcgattctagttacagaaaaaaatgatcaagttagttatgatcttcaaaatgtaagtgttaatgatttatctgaaggagaagtattaattaaagtagcatattcttcaatcaattataaagatatgctggctgttcaaaaaaatggaggtgtaattcgtaactatccaatgattcctggaattgatctaagtgggactatcgttcatacaacagataatcgtttcgtagagggtcaacaagttattgtcacaggtttcgctatgggcatgagccacactggaggtttttctgaatatgctagagtacctgcgaattggattgttcctttgccaaataacttgactttaaaagaagcaatgatttttggaacagcaggctttaccgcagctctttctatcatggctttacaggaaaatggtatgagtacgaaaaatcaacctaatatactcgttacagggtcaactggtggagttggtagcattgctatacaattattatctaaaattgggtacaacaatatttttgctttagtgcgtaaagataatcaagttgatatagcaaaatctttaggagcagctgatgtcatttttgcaaacgaattaggagagctaaaaaaaccattaaacaagcaaaaatttgacttcgtcttagataccgtaggaggagatgtggcttctgtgatcattcctcaaatttcttatggtggaagcatgagcatgtgcgggaatgcaggtggatttaaattaacaacaactgtgttaccttttattctaagagggatcaaccttctagggatcgattctgtaaatgtaccaatcaataaacgtaaagtaatttggaacgagatagcaaacgaatggaatatctcccaaacgactctagtcaatgagattacgctcgatacgttacctgaaaaaattgaagctattaaaaatggccaacatttaggaagaaccattattaaatattaagataaacgaactttatttatttaaattacaccagacaaatattgaatgtattgatgcagataccccatcccaaacaggtggggtacatctattcaaaaaagagcgggacatgctagtgctaaaataccctcagatatttataatcatgtcacaaacaaattagaatttaacaccgcagaacactttaatcgttttaacctaaaaaaacaacctgcaaaaaacaaaaaacccttgctaggcaagggtttcaacgatgattccgactgggctcgaaccagcgacctctaccctgtcaaggtagatatatgaaatcctgtgattatcaacgataccctcaattcgcttataaaccttgatacataagctttccttacccttctgtatcctcttgtgttctttcgtattttttaaaaaccgaaaaaaatgttaccttttttgttacctttttatacacctgttttaaacttatgattgtatgcaaatttaagcttttccaccttctaaatgaagtacttcttttactgtattttgactccaattttaataaaatccaaagatttttttgaaaatacttcttataaagatgcttaattccgatgtgtaggcagctattagaattggaataataataacacccaatgcccaccaaataatctgtaaaatgtttataaatttattggagttttcaaatcctatgtaccttataatcatttttggaagggttaaaatcgtttcaacccaagctattggattaaacgaactaaacattctttttctatagatgccttttgcttcagagagaattctataaatcgtaaatgctattgctttatctttaattggaaactgctcaattggatctattgtcattgttcgaatatgcccacctccaattggctgttcatgtggaattttaatattctttaatcctgcattttcaattaaagcttttacatctgatttatactcagctaagtttacagtagaacttgaacttgactcttttaaccacctctcataccaattaatgaatttaatacattgtttaaatttagataagttataaataaaattactaaataatacaagaataaagcaaagaacataaaccaatcttaataaacctcccacaacaacctaataaaagaatgatttcattcaaaaaacttttgtctctcttttaatcttctattctcttcctccaattctgcaatgtactcttcatactgttgattttgcgcttgtcttccaccagttattttattaaagatagcgtacatgtatacaaacattactggtactcccattattggcccgaataagatgaataccaaccaaactgcaaatcctccgccaaaaataatcgtatttaaactcatggctacacccctttatcattaggaatattttatcatacggttattcaacactcaccagttttttcatttattttcctctgtttacccctaaatacgagtatgatgaccgtcatagtgttcctattatagcgtgtcggttaggactactccctttaacccaatatcacgcgattttcttccatcattagtcttgacttgtcgtttgctttttggcttgataggttgaaagcaatggacaacggctggacaagttgtctgcctgaatttgcttgtaaaaaataaacaaactcagacaggcgactgactaacttgatagtgtatcaagcttatggtatccgtatatgtcaccctatttgccgttggttattctccaaacaagcctactgtgtcaagtgtccctaacagtttcagaaagcccatatatggactctcctacttgtggcttgtcctgcatcgtcagaaacgatacacccatccttcgtacagcacttcatggcagctttcgcctttcagatacatgtgcaaataggaaagcacagtggtatcctatcctcattttttgcatcggctgagtcactaccctttcaagtttaacgtgtgttagcgcattccacgacagccttacccttaaatttggcatcactaaagacaacaccttgatccaggagcatagactgattctattcagttaagtgaggtaaactttacttacctcacaaaatccacgacctatgtttaaatgaggccgtaatgtgaactattgaatatagattaaaaataagttagaatgggctggtatcatgggatttgtaccaacccatcagattagatagtgcgccaacacttttctaatcagctagaaatgacgatcatgagcagtaggaatatccctattaagctcatgattgttacaaataacaattcatccatgtacctttttaatagcttccccattaaattaaccccactacagctaactcaccactattatccactgcaaataactcatcacggccataaatatcaagcatgttatactcatcatcagcgactccatattgattattgctatgtacttcttcgattgttcctagtccgtataacgtttgtactctttgacctacagatagtttccagtttggattaacattgtttaacatgttcatttcccctttgtaattggtttagttggatcaaggattatgcaatcaaattccgtttcctgattcttcggttctaatatcctcaaatcggttaagacttcccaaagcgtgatttgcttcaatagatgtgtaacgacctcagcaagcgtttctaagtctgcatacggaacatttcttcctatataccagatctttccctcatcgtagttaccatcagttcgttgagtgatttcagctaaaacaatctggccatcacactcccctactgcataaccttctttaacgatgattgctgaataaaggttgttgatttcttgtgtgttgaattccgtttgaacgattgtaatatggttcatttaatcacccctccaacttcgttttgatgttgacttaatcataatccaacttcaaaaagaagtcaactttattttgaagtcattttagagaaaaagccagtttttgattttattttttgttataatcaaaaaggaggtgaaactgttgactaaaattgttaaaacaagattgaaagaaatattagatgaacgtggcttatcaattagaggtttcgccttcggaaatgaccttagcttcgaaactgtcagaaggctttacaataacactgctaaacaataccaacgtgaaacactgggcaacatttgcgaagccttggatataaaaattgaggatttactttacattacagaagatgattctaatgactcttaagcaaaagtattgctttttatttttttgaaatttattaaacaaaacaattgcaatggtgatacaaatagttagaggtaagcaaaatggaagaaaaattattcaaattgattgaacaattggcttcggacgtatcaaccattaaacaagatgtgaaagaaattaaatccacagtcaccaagctggaagaaaatgagcagtattataattggtcagaggtgtagctatatggctgaagccgaacagattttgaaagctattcaagaactttctacacaattaaaagaaattgaattcaatattgttgaattcagtgatgaagtaaagaatgaattcaatcaaataaataaaaaattagatagacaaaatagccacttacattaatgtgtaggtggttttttcatgcgtaaatataccccttttacgctgtaagaaattagtaatacaactaatgaaacaatgacaaaaaacgtgtgaattaactactatttcttctaatttatgtaaaatttatttcattttgtgatatcctcactattgaaaaatgattagaaaggaagtattccaatgaaaaagttttttgttaagatgttgctagttctcatttcagcagcagtatttattccaactacagctacacacgcagcagaaaaggtcgaacagaaagaagatttggtagtaagtatcaaacctactgagcttcagaaacaacttgctttaagagatgtaccattagaaaaacaagaagccttgattcaagcatttaaagctattgagaatgctaacaatgatccacttgctactacaaatggccctaaaagtgcgggtattaaggcagcaatcaaagtaattaaaggtttagtaaataacgactgggcaaaatgggttttatcacaacgttttggaaagcaagctgtaaatggtactgtcaaacacgcaaacaagatcattaaagaattagaaaaaattcttgatactccaaaaaatgcagctggtagggctcgagaggttgtttctgcagagcttagaaaacatatagatggaggtgtagctgatacaatcggacttgttgttgaatacattgttctcactgctgatctactcttactttagataaaaggatggtgactgtatatgtcacaaaatcaattcattcaattccaaaaagccaatggtttagacgatgaagacgttcaattcctcatcactctctcaggagcattttgcagttgtgaagaggaagacaaaaaggcatatgatataacaaggttagcgttcattagacactttggtgaagaattaaacctttcagaaattgaaggtaacactagagaagaatatgaaaagatcatcaatcaatttctaagcaagaaggataaaaaaattaatgtagatgaactcttacaatctttttatgctgcagatatgatggatggattaaaaaagaaattcaattaatggccttcatttgaaggtcttttttaataccatcatttacatatagaccctctcctctattcttcttattattaattttagaaattcaattagaggagttttatcgtggtcaaaactaatagaggaaattggaaggaaatctttgaacatgcaaagaagaatacgacagagacattaacttttccaggtaagccttactcaatagcaatctttcctcaagtatacggtgaccttgttacagaagatcaattctatcaagaattagcaaacataatcataaaagaagcccgtatggaatatgagtttaaagagggtgatgaatattaacgaacacaaaaacaagtcaaaaaagaaaaaggaatcaatcgaaaactataaggttgttacagatttaactgaagaggaaattaaagaatacgttgaagaaataatggagtccgaagaattctataaggtattcgaaagatttatgtacaaatataatctagtctaaaataaacaaaccagtcctttcttgaattactcgaatggactggttatttaatattcaatttaagtacacttccgcacttattaatcaatcaaactaatcgaatgattaatccagcaatggcaataaaagctcctacagtccaaataatttgagcattacgtgctttcgtaactgcaagttctatatctgctttacttgccaagtctttactttcaatcgcggcagttgttatgtttataacttcttctttagaaggcaaatcatcaattttttttgttctttcgataagaatagccacatctttttcgatattgtatactttttcagttaacttttccatatcgtcatcactctccttaccgggggcaaattgtaatgaagtttgtgttagttcgtgtgctattgtatttaattgtactataaaatcgttcatcttactttcaaagtcataaacttttacaaatttattttgacttttttcgacattagatctgtcttgatggactattttcacttttgattgggggtgcttcttgtctacataagaacttaaactaactatattactacgaactccagctcgttcaattaccctcatcattatctttattccccactaaattacttagtacacttatcacttctttgatgctataatcatccatctcaatttctattgattttccatcatttcttgaaaatttcacaacttttttttcatttagtggatcctcagaagacaccacgctaaatagttttagtggctctgttctattaaaataaaattgcattactattactttaattgtcttacaaaaagatatagcgtcttttttataatttttagggatatcatctgcccatttcatacgcttgtcttctaaataaaacccttgaaatcctagcgaaacaaaagaatctcccaatataggttttaaaacttcatccagttcatctatacaatgcggccattcacttctattttgatatgtgttaattattgataacgctttagaaaaaatcattggatcttctttgtatttttcaacactttgtccaaaatactctaatatatcataaccattttcatatgccatgtcttacactcctaatagtttatgtcttaagtctaggaatgtttccacgtaatgtcaataaaattaattttttctaaaccatctcccttctcccaattggtggcaatcgtaagacaaggactatttatttacttcaataatgatgcaagtttcgctctagttttatccccataaattccgtcaggtactaaaccatgcatagactggaatcgtcttaccgcatcagccgttttcactccgtagtatccatcaatgccgttgtttttagcacctttttctgggtaaaaatagagtgcagcaagagcttcttgaatttgctttacagccgttcctttcatcataggtgtacttaccttaaagatacctgcaggaagcgtgtacttagctttagaggatgatttagaaggtgtttttgttggagttgttttaggtggttttgatgctgaagaagtcttacctgtaattgatttcaactctttttcaattgacgctttaaacgaatcccatcgaccttctgcaagaatgcggtgtggacaatacttaccagaccaatcttgatgcttacggattctatcattgccccaaccacgttcttttaaaagttgtgcgataaatttaatggccatcgcttcagcttttttatatttgtctccacctgattttgaatagcagatttctaaaccgattgatgttctattccctgagtttactgcttccccatctcctgtatgtctagctgaacgatcaacaggaataccttgtacaactccgtcaccatctacagcataatgaaatgatactggctggttgttaccgaccatataattaacctcattagctgcaggagcatcattataagtgttatgtactgtgatgtattttgcgttcatagagtaaggtgctttcagtctgtgtttagatgatgctactaagttctttttaattgtaattgccattattaattacctccgtttttatcttcagtgtctttttcgattacttgaagtctatctttaatgaatgaagggattttaacgcccatttgcgctaagttttccagaatggatagcccttcgtttgcgatatagaatagaactgtactaaatactaaagctcctcccaagttcgcaatttgatcgataatgtttgctaagataaccactgcaaaactaaagaactttctaacataaccgaaccaagcattcttcgatctaagatttccttcctttgtagctttgaccactcctgttaagatgtccaccaaagacagtaacaggagcaagtctagatatttaacacctccgaaaaggtatgttgttgcaatttctaggttttctaaatttaaaataatttttattcaatcctttctgtgtttatttcataaaaaataagcctatacctcgtatggctcacctgtgatttcttcatattgttcaggagtaacatagccctcttgaataccctcttgtaattcctcaacggtacagtcattaaaggacatagcttgctttaccattgaagttgtagcccatttataaaacagtgccagcacccagaaattaagattcatttgttgtaaaacctccttttagtttaaggatttctaattgaatttctgccagctgtttccctaatgttgcatttactctttctgactgttgacgagcgattttttctttagctaattgttctccaatgagaagcaattgtttttcaacctgagtcataggctgttcattgtctagtttgaggtactcttgccaagcagactccaactcttcatcagaggggataggctcctctaatgcccaggtgtctatgaattgtccttcaccatcatctctaacagagaaatccttacctagttcagcatctggatataaatatataatcgctagtgccttattcattttttcactcctatctcaaataactcatcgtaacgtaagctgtgtttattgttattgttttgctagtgccctttggcgttatgtagaaagtcactttgtctccagctttaaatttttgtgttaaataaagcacacacgtactcgatgctgtcgttgggttccaatttccaaaacgttgaaattctgttccattcacatagcacgataaaatattatctgatccgactgtaatactattacaagttacataaagcctgattagatatagtccgttattttttagagtaatctcagaacgtgttcgattgtactcggctaggtcgtctgctcgtgttgctccgaaaacaagttttgttgcaacattttcagcagcggaaacggatgaattatcttgatcataggtatcaacaaaagtgctatttgccacatcttctacagttaatacctttttccaccctttaaaatctccattagtatgaacagttccaaaccacatcgtattcttgtagctcgctacagctataatcatttttctacccgatccactttcggacacatcataattaaaccacccagtatcagatggatcaggattgtttaaaagtctgttgttaatcccaaaataaaaccctggcggtaaagtgagtaaatcagaaccttcaggtatcaattttcgtgtccctgaatcttgtgtcaatttgtataattgaccgttgttccatttatccttttcagcttcggttatagcgtcttgatctgtcaaaagacgtttccaaccactccaaatgctattgtttaaatagttggtgtagatgttatttaagtagtccgttgcatatacccatccgaaagaagctttgccgtttgtggaatcagtcatatgaaagaagcctctaaacgaacgattattcggaaggtcttttgaccctgcaattgcatagaacgttccttgacctaatccattattgataacagaatctaagatgcttatggatgtgtctttaagagagagcaatggcatacctgtatctgccgtgatttttttctgctgaaatcctgacacaaagtcttttgacttttgcaaagctgcatctgcttttgcctgtgacccagttgttgtttcttttgcatcccaagacttttgttttgcttctgtgacatgtagctttgaatcctttgcatgttcatctactttagcttgtgcgccttctttagtctcgatcttttctagatcttcaaacttcgcttttaactcctctaaagtttgctttgcttcagaagacattttctctattgcatatttaagtgtctcaaaatcatcaatatagtattctgctaggggtacaatgtcttgatctactaaactttgttcgatattgaatgtaaattcatgaactgacattgtctgaccattgctataaaataaaacaaggacagctttcactgtcccaaattgcttaatctcataatcatcaagaatatattctgctttgccttccactttatcaagaattgtaacttctttcatcctctttgaaccattaatgaagaccattgttaattttccttttaatgcagacaaaggcagcgtctcaccatctttaaaaatctgaaaatctagcttagctgtgcctttatccattgtagaaaaccttattttagtaccagtcaccccttggttataagggtttacagtaaattcaattggtgcttttttgtaaacaggcatgtgttccctcctttaagaaatgttaacaggcgttgtaatcggattgctacttgaatctttataactctctgagtaacctgatccttttacattgtttccatagtgcgtaatattagatgttgtattagtaaagttaattccatgtctcattttcttacctgatactcgaatctctgtgatctttgaatcactcactccagtcatcaaaataagtccatcatattcattatctgatccagaaacagaacgagtcccagcattgataactgtatcgttgttagatacaaaacctttagaatttccagaaacagaaataccagaatatccagtattcacaatggtattatcttttgaagttacatagtcgcaggagccctcttcaaggcgtagaccgttacctttcacatctttaactgtgttattttcaacaataccatagctacttcttgtcacaagaaccccgtgatgccctacgttcttgacagtgttatctttaataatgaagtcattcacatcagatacatgaataccatgcttcaatttaactccatcaattgtatttccaatgatttgaacatcgtcaatagtttgatagccctttctcccaaacacttgaattgcgtgtttttctgtgatgttagtgaaagtattgttattaattttttgcctttttaccttgttgatgcgatttgttggattgccatttgcatcttgtgtgtattgcgaattgattttaggtagaagcgttctaacaccaccataacagttgttaaatgtattcccttctacagctatgtcttgccatttgtttcctgacacagcccattctgtagtatcttcaacagtgttatttttaaagttaatgtgagaatatagatagccgtcagtgcttgtgtgagagtcaattgctcttgcgtagccaccgagctttttagattttctaaacttgcagttttccacattgatttttcgtgtaactgtgttgtcgtatgctccgaaagaaccaaagtttgcagatgatctcattaaatcaacctgaattgcagctgaaaaccatctatctcctttgtaatccacaaacccttcaaatttaatgtcatcaaaatcactttcttctatccctgctagatcaaaagcgtgacccccacatacgttacttacggttatcccagacaccttgatgcctctagcgtgaccaaagccaaagactgagcattgttctttcactctgtctcctgcactatctaattcaccgaaaccatcaatcttaatatttccatgtccattgtacccagtgaacatatcgccactctgtccatttacaaacattgatcctacaaatccatcttctctagctaggtaaaccccatctgaaaatgtaatgcgtgtatctttatagatagtaagcttttctgaaatcgtgtaattgcctggtggaatagcaatccaaattggataaagcaatcccagttgcaatgcttctttcatagccttagtaaaattaccattgtgctttctcaatatttccttgaacggtacagccatccttgcgtcatcaatcttgttatgagttaattgaaaatcatagtccaatctttcatctaacgtggccagtatctttgcatctaaggctactctggatacaatcaactctttaatattgttgccgtcttgttctgttgctaaattcgacattttagctcttaatctattcactaaagcagccaattcaaatccttcgtgagtaatattttttgagctgtgagctttggagctgcttttgtgatcactaataatcctctctaaatcatttaaggctctctcaatagtggccatatcaccctttaacgctgcttgataaacagagtttaaaatcgttgggtattctttttttagtcttaccgtcattccttcactcctttattgagatgtaaagtcagctaaccgaacatcatcaaaatatttttttgtctcaaggatttttttggttgcatttaattgataatcaacaatgcttcttcttgtgttggagaatattagtttggggcttgaataggggtttaaggggttatattgaatttctataagcctaacatcagattcataggttataccgtagccagtatcagctatgatatgtagcgtgtcacctttccaaaactcttcttgaatatctaatagttcttcatcgaaaacattcacataatcaatttcaactgtgatttctgggaatggatttacatgtttcttcaatttagaaagcatagttgatggcttcttaattgtttcatctttcaagggctctccccaacgatactcaccgtctaacaaatatttatcttcatcagggtgaatatataagataggttcaaataaatactcaggttcctttggcttctctttgtctttatcatcagttgatgctgttttattctctttcatagcgccatatccccaagctctagttgtactattttttgttgagaaagaaacgttgatgcctttcatatttactctggaatccaatgtatggtcaattgttttgcccattttcttataaacaattattttgtagttatcaacatctaactctgcttcatagtcttctataatttgagacagtaattcagaagagttcttatcaccaaaattctcttgttcaatttcaggaaacttgctttcactatctttcaaaacgtatgtaaaccttgtatcctttaaagcaatatctaaagcttcttttattttcatttttttagtaattggctttacatcgtcatttcttttgttaataagtaatacaaaaacgtgacttgctttaatagattttgttacagtgccattttcatcttgtttcaggtcaacatcggttatgaaatatttttgatgcttatgtactttctcatcgagatatataacattatcaggaacaagtaaattaaattcagcttggttatcggtagtccttatgagattgaaggtaatatctttcttcccttctgcattatcagtcatatcaatggatgtcccaatgatctcaattaagtcttttccgtctttagaagcaacaaaaatttgattaaaataagtgtctttaggtaggttctcatttttttcagattccgatcccaaatcctctttactcgggaagggtagatcagtatcaggattatcaggaacatcgggatcatctggcacgttagctatatcatcgtattgagtcagattatacgtctcaataatattgatcaatttagaagggtagttgatatctgtagcatatccagcatctttgacagcctgacaagccttcttatagtttttctcaccaacaactgctttgtaccttgataaacgagtgtataaacttcctaaatcttctaagctttgagtatatgatgggtattttctaaactttgcttgaattcgggttacattaccacgcttatcttgttcataagtccacatcaaaacatatttgccattataagttcccttaacaccaaataaattctttgcagacttagctagtccactttcaccaaacccactctctaagcaaccttgagcaataactagactggccaatacattatactttttatataccttttgagcgcctgaagacagatcctttataaaatcttttgctgccattttagccccctatttataataaaatcttgtgttgaaattaatattgaaacttttacaattccttacttcaaactcattccaaccaatatccaatccaggcatccttccagatgttttaagcctttgattgcctacaactagatactgtcgcacattcttaacctcttgattttttttcaattcatcacttatagtgacaatttctccagtggtatgattgatcaacgagatattcttccctgcccctttgaatgaaaccttatagtcatgattaacagtattgatgtaagcatcacccatgttaaagactctaaaaaagttttggttggtgaatgagtattttttatcatcaatcgtttccatgttcattcctatgttccagttctcaccattcaaattcagaattgtagatgaagtatgaattgattctgctaaaccattaatcgctgtaaatacaacattaaagctcgttgcagtacgtctatcagctttaggtatttcataagaatcatcacaggttacaagaaatcttcgattgggcaataaagaggaagatatgtagtatggcttaggtctagttagcaatctataaatttcgtgtctatgttggtaaaagttttcatcgatacctgaatcaaccttaatttgaacagttatttttcgctctttgtaagtaatgtctcttggatgctgcgtttgaacgacaccattcgttctagaaaatgaagtggtctctcgttcaattgatgctgattcaggagtgaattttaatgctttaaaataaggaagcctctcacttaatccgagacttccttcaccatcgttaaaatcaatatttaatatgtctttcatacccctactcttacaccacctttaaatgccttatcttctaacctagcaccactctgtttctctaattttgaagtgtctatatgttttaaagctaattgaccaattgttttgccctctagtgtaataggcgcaggttgaataattatctgttgtccttgtccaactgtatcaacacctaaagcaccagtactgcttaaagctgtgataagctcatttatctttctgtttaaatgaggagtatccacttcgttttttacaactaactcagatttaaaatttaacatttgttgttttgcaccttgaatattcatggacattccttgtaattcatcttttaatgaaccgtgtgcggttttccccattgaagcagcactagctttaactttacccgctgtcttagacattccaatgactaaaccatcaccaaagttaacaccttccgcaattgttttcttggcaggagatttcgagtctattgagcttttaagggatcgaattgctactttaccaattgcccaagcagctttccatatcgttccaccatctccacccatgcttcgaatgccatttgcaaaacccttagaaaaatcagctccagtgttttttgtttttacgctagataaacctttcttaccactgtttgcaacagtcctaccagatgaactagcattgcctgattgaccttttaaacctgtagcaaattgaactcctgcttttgcaccaccgccaccatcagttgttttagatagtaggtttgtaacgctagaactcaaagaactcgctgtagattggttggtaccttttgtagaacttaagcctgcattatgcgctgatccttttcctgccccagcgttccttgcctgaccattgttttttccaagttcgtttaaaacagtttgctgtagaatagaactcgttgaaacagcgcctggccttgtcgatcctaaaccagcattaaatgaattacctttgttaacaccagcttgtctaggaataccgttgttactattaagctgattgtttactgcttgttgaagaattgttcctttttgtgcgctaaacggttcaatggatcctaaaccatcaacaaactcttgcccttgtttttttccagcttcctttgcattggtaggtttgtttaattcctgctcaacagaataaatcaattctgcggcttgttccttagcgtcagctgctgtcattcctgatccttgatagaagtcttctaacgcctgttgagtagctttaagagccttatctttagattggccgaggctttgcaaaaactctatttgcttattcgcccatctctcttgatatcgggtttcattttcctcaatctctgttgctaaacccattgagtttgaagcgaactctctttgcttctcaaaagctttccccgtttctaaatcaagtagcttaccttgatcagacattttcgagaataaagctcttgaattttcttcgtaaacagaggtgttctctgctaatgccgatttataatctgctgtactcttcttcagtaagctcgttctatctttcgattcaatatacccttgtgcatgaagcttattaatcacttcattacggtaattaaaatcttgtttagctgctttctgtccttcttcataaattttctttatgttattgttatactcttgtgcttgtttgaaagacagcttcccttgttgatcagtaacagctttttgcatagcaatggcttctttttgattggctgcaaatttgcttgtagactgttcgaaatagctgaggatattattgtattgttttaactgagaggcgttcattttagaggtatcgagatttgtttcctcttggagttttttgagggctttatatttgttctttgcttctaaaacgtctttatcaatttcaccaatcatcttatcagtgattttttcgccttgtttctttacgtttccatcagtgtcttcatacaaaccctttaaaacaactaaagcatcagttttaagttgctcaagttctttaactaactcgtttctcatttgcgaataagtctcaacgagctgcgaagacattttcttagcttctgagccagatgtacgagttaattcaaagagttgtaattctgctttttctcttaaatcgacataagcttttgcagcttttttcgtaccttctgaaacaccttcgccgtatagaagcatggattctctagctttttcttgctgcttctctaggtttttatgagcttctacagatgcatatatgccaactcctagaacccccaagagagcggttgttccaatgatagctaaacccacaggccccgcaaatgccattaacgctccaattccagccactaaagtcgcagtagcagctgtaacacctagcacaccagctgttaacaaagcggttttacctactatcgcttgtgtaccactgtctaaattattaaacattgaaattagctttgtgcctttatccgcaagctttccaatactagggagtataccgttagcgatattgatttttgccccttctaatgcggaatcaaattcaacgatgcttcctttagcgttatctaacattgtagtggccattttcttagcagcaccatcagattttttcagctctgcagtatttttagctaaagcttttgatcctcgttctaacaggatagcccaatgcttgtaagactctgcaccaacaattgtttttaatgcagctgccttttgttccttcgtcatacctttcataccgatttcaaattctttcactacttcaggcattgatttcatgttgcccgccgcatcaaagaatgagaagcccaatttatcgatttctttttgagctttcttcgctggagttgcaagacgaataagagttgtaccaaatgcttgaccagcaattgatccttgtagacctgcatccccaaatgccattaccgcagctgcagactcttccattccccagcctaatgaattggcgtttggagctaagaacttcatcgcctcacccatttgttcaacattggtgttagcgttggcggcagcatacgcaattacatctgacgcatgtcctgccttgctggcctctaaagaaaaggcttgcatcatgtttgaagaaatgtcagctgcagcgccaagctcaagttgtcctgcagcagctaaatcaagcatacctggcatggcggccataatatcttttgttttgaaaccagccatagctaagaattgttgggcttcagctgcttgtgttgctgtaaatacagttgttgccccaagatccattgactgctgtcttaactgagcaaattcctttgctgttgctcctgaaattgctttaacaccactcatttgcttttcaaatgtcatggctgtatcaattgcatttttaagtggtgcggcaactccagcaaaagcgatacctgttgtaatagcaacagatgaacctatattcctcatcttgttaccagcgttctccattctatctccaagctgattaattcttgaagcgcttcttctagcctgatcttcaaactgtcttaacctttgggttgtttgagttatggagttttgagtcctgttcatagcagcttgtgcattatttaatcttatagacaagttcctagttgtctcagcgatcttttttgtttcctgagcatctttccctttggccttagaagcttgctcatgtgcttgttgtaaagcctttaccctcatcttgttagcttctaaaacattgtttaaatgctttattttcgcttcggattctttaattgagttaccccaagtcccaacagctgttctattcttttcaaactcggatttagattgcttcattatgtttgtggcatctgccatatcttttctaaatctggtgctgtttgcgtataactcaacaccaatacgcctattactcatcttccacctccaatcttaaataaataacggtatttgatcgatatatagtttttcatcttttttaccaggtgcatcacttttagaatttgcaactaatctcgcttgccgttttatatggtagagtaaatccatactatctatttcattttgagaatagccgagttcagctagtgcgttatataaatctaaaactgaatcgactaatgttactttcccatttcctcactaacttcattgtttgaactcaaaagagacaacgcttcatcaattgcacccacaacataaatacaggttgcgtaaacaacatctctcaaatttctagcatcaatgcctttttcaaattgctctacatcaaactggttgtcaaacacttcaaccacaaaggcacagtatttatccaaattaaataccataaagccttcagtttctaattcttctgctgtttcagctgctagtctatagtgttcgccagaaataaatggtttcgttgtaaacttctttttcttgttgttaagttttaactcaatcgttaatggtttcaaaaattattcctcctcttatgaaaaaaggagtgcataaaagcaccccttaagatttatcagttgttgttgttttagaagcttgtgtgaaaacacttccttcaaatacaacatcgttgaaccagttcttcccgttagtaaattcactgtctccatcctcagcggtagccttccatctgttttggccataatcaacaggcataaacttaatagaaatcttaggctttgcatattcttttgatgtttcatcagtcttatgttcagagcccattagagatggaagtccttttaacaaccaagtgtatctatagttttctgagttagattgtttcgctctaaaacctaaagcgatataagctgtttggtcgtttttacttgaaaattgaactccattttctctcttttgattgtaaattttctcttgaagctttagtggtaagtctgctacttcaatttctacatcaatatcacctaagttgtttgtaacatcataagtaccgttgtcggcataaaatgaatctgattcagatttaggatcaattgatacgtttactgcacctggcagcctttctggtttttcgtatttcagactttcatatgtgtcctcagttaggattgcgacatgaaacatatctaatccgtgaattgttttacccaataaatttcctcctaattaaaaaagctcttgcgatatcgcaaggctttgtgatagattttctcttcaatttctggcaagtcttgagagtcatatctgacataccccaattctttaatgcatttatttaatgctttaacaatgagcttttcttttgaaacagtggatgaattacagaacacactgaattgataacgtacttctgaaccttgtgattcattgtcataaaagttatcttctgcgtttttaagttcaaggaatataattctcggatacttggtcgaatcagatgcaattcctctatgaattccaccttcaactaaagtatttaattctttgtccgactttaacttggaggcgatttctgaagctgcatctaagctcatttaatcacccctgttaaaattctttctacagcttgcatagctgcatcaccagcgctgtctgcacttttttcaataaatggatgaggacgcatcttggaagttccgtactctaaaaaacgaacacgataattcaccttcccattgccgcctatcgttacaaacttttcaagcgctttgttttctttagatctagaaacaactatattatccttaatatgaggctgttgcttatcagacacaccgacagtttttctttgttcttcagcaattatttctccaccagttttcaatgcaacatcttctactcgttgaacatcatcagctacacgcattagatcagaaataacttgatcgaatcctgtgatatcgagattagctatttaactcaacctcctcacatagaatttccaatgttctatttttttcttcaacgttgtttatatctaaaatattaaagaccctgtataactgctctccatttagcccttttccattccttaatgtaaaacgcatgtctctagttataaaaggcctatacctaacttcaattctctttggtgactttgctcctaaagcccccgcaatagtcatttcagcatttctcaacatgccatttacagagcccttcagctctgttatgtcttggtattcttcaattgtatttaattcgtcatcttgataggaaacccacctctgaagaatcaaactcttgttgtattttccagcacttttatttttcaaataagtagacctcctcctaactcccgatgctcagttgggtaagaatacttttcaaactgaaatctaaactttttacacttgaatctgtaactggaagtctattttcatagtgatgagacacaaacaggaatagaccaagcttatgcagatcatcatcagtgtctactgtgatcccaagcttagtgaaatgattgacagctgcatttaaaagaagagtgaggagtttatcatccccactccaatcatcttctatagagagatattgcttcacctcttctaacatactatcacctctttttattcagtaggttcagtaggcattggcgtaggggcaggtgtagcagttaaatcaatttgaccatacacataagcttccttatcagcagggataacatcaaaagactcaattaaacgcaatgcaacttggtttttattgaatagtgcatgatccgacatgtctagttgcatttgttcacgttccacaaatgtaactccttctgttgtcgcaccgtaaaaaataggagctttatttttttctgttggaagtgttgcgtttgagaaaacttcaatcactgtcccattaatcatcttttgagttttatttactggattcggttctagaataggtcgcccaaaaccgtctttttcgttatccaaatgctcaaaaccgtcttggtttgtaatgattttcatgccgatttgtaaagtaggatcaagatctttattgatagaagttttaaggtcagaatagcctttgagaacttttggagtcttatctttctttaattcagcaaagattttagtgttttcagtctggatagcctttttgttaaaccactttcctaaatagggtactaaacctccagtttcattctttaaaagttttctagaaacagggaggagagctccgtagtctttaacactataagaaacatttttgaactgaggtttatcactatcaggaattgtttcaccatcagtaaagttctctaattcaacaatttttccattgctttcatacacaaaagaaccttcaagcgtagttgtaggataattgtttactaggtctttcgcagatttatattcacgtctaagttcagtaatttgagtgtgaatatcctttggcactaagtaatttgcactatcatcaccacctgtgagcaatgcattctcagcatctgtaagtgattcacctctaattactttgtgaaatgctttcatctcatcaactttttcatttttatcattaaatttatcttcgaatgccaaatcttctttgtcatcagcaagtaatgcagactgaatctcaaattctttacgcagattttcaatttcatcacttacttctttagctttatctaagtttttctgctctagtaagcttttagcctcagcctttttgttgttgatttgcttcaatagttctctaagttctttattcattatttttcctcctatatttgagcttaaataattgatagctcaattaacatttgattgattttattttgttgggattgttcgttctttgtttctttgggttgattttggggttttgtaaattgttgaggtattttactgtagtttttgaaataatcagaggtacaagcgaccatttcattttcttgggatacttcgacattgaagtattttgaagcttcaaagccattcaaccaagtttcatcattgaccatttgcttaatagtgttgatatcaaccccctcttttaaattctctgcatacacgttaagaattccttgctcaatttgatcaaggtcatcagcagtttttctcatatcatcagaattgcctacaataccactccacggtttgtggatcattagaaaggcgtttgaagggatcactattttatcccctgccatagcaataacagatgcgattgatccagctaaaccatccacatgaactgttttaaaagcattgtttcttttcaacatgttgtaaattgcaagtcctgcaaatacagagccacctccgctattgacgtaaatatttagattctttacgccttctacttgtgttaaaaagtctctgacatcttcaggacatgtgtcagaatcttcccatttaccccattcagaactaactatatctccatagaaatacacatccgctgattgttcagattggtttttaatctgtaagaatttattcgctatttgaatcacctccttttaaagcatttgatttacctaattggtagtcatctgcaatatcgatagaaactgaatttaaactaaccctatgggagttgcctgattcacctattccattcatatcttctagatttagtacatcattgatgctcaaagccccaatgtcagtcatggttttataataatttgaacgtgattcatcatcgcttcttagcgaacttctaatattaaacttcacataatggtcagagtcgctgtcagtgaataacttataattcaattcctcttcaatggccactaattcaggctgtatcgtgttagaaacaaactccatagactggtgttcaatgttattaaacgtgctcttatcaagttcagaaagcatatgtaatggaacgttaaatatcctggcaatttcagcgatattaaatttttgagttgcaatatactcagcatcaactaggttcatcgacaacggttgataatcaaacttcccatctaaaacggcaactttgttaaaattatccagaccagagttagcttcctcccacgcctgtctaactttctctttagcctctcctgagagtatttcttcgcttttcaaaatccctttggtagtagttccatttttatagaaagaccccacatatttctgtgccgccttcatagtcccagcagtttctcttgcgatggttactggagacttgccaactattccatcaatagataaataaggaatgtgcaatatttcttctgagtgaaatttcttaatatccccattcttaccttgatataaataccatatatcctcattaacatcttcaatgattctaatcctattaggttcaagaatcttcaactctttcggatatccattttttccagtcacaattctcacataagcattcccccacaaatttctgtggactgttattgtgtgcttaaatacatatggtgtttggagtgagtttggtcgtttttctaaaagcttaacaacaggatggtctatagctctctgtctcccattctcggtttttcggaacacttgtaacggcaacttcgctgtgtgtcgagccttaatatcaacagcagcaaagatagcacctatgttaagtgaattttctggtgtaatgacttcaccactacttgaaatacttaaagaagagaacgctcctaacccattccaatttgttgcgctgtttttaaaaatcttatctaagattatgatctttcacctcctttccacagcagaacaccccaagaaataaggattccacctagtaaataattaccgaaattaaggctgatcccataagatgttagaatgattaggagtaatcctgataacagaaaaaagtcgccccatgttagtttcacgactcctttaaaactgttgaacttattcatgatgttgcctaaaatagttttcaaaatacacctcctaaaaactaaaatcatctttcagtacgtgtttatctaagctgttgctatattcatgcagcatagctcctgtgtgtgcattcataagagcagcgacactatctattttttcttttgatctcttctttgaaagcttgtatgcatattcatcgccttcggttacagcattggacatggagtatgttaataaagggttattatcatgaatcactttattttggaaaacgaggtgtttgaagtttttggttgctggggaaagagactgcaatctttgaggagtttctattacagtgtagccttcttcttcaagtaaaatttttaagtggcttgcatcccatgcgtcataatgtatctgtttcactttccagtcttctttttttactttatcagttatccatttcacaatatcccgatagtcgtttactgatcctggagttctagtaatccatccctctctttcccatagatcataaggggctttttcattctttattttatagtgcatcatttcatctggaacgaaagaatgactttgaatcgcaaacctcccatcatgaagaggatgaattgtagacactgagcagttatcgtcagttttcgccaaatcaattccgacatagcactcagaaccttttaaatctgggaattcatctttatctaatcccatccctttccacttttcaatcggcatgtaagagttgtcgtgttttgaatctaaccacatattcatagattttattaagtagtcttttaaatcatcgccctgtttttcttttgcctcttcagaaaaatcgattaacttttcaagtgaatccttgtcttctgctgctaaagggttcgatttaacaaagtttttaacatcgaaaggatcatcgtttttatctaattgtgctatataaacaaaatacttctcattttttactgcaccttttaaaatcttctcgcagtaatcttgttcgactttacaagcggaagttggatcatccccagctgtacttataatagatatcaagctttgtttttgtgttacagttcccttttcaagaagcttaaccatctgattgtctttgtgcgcatggtactcatcgatgataccgcagtgaggattaaatccatctattgtgcctgtatctttaccaagagcaacaatagtacctccgttaattctacatactatttcactagcatgttcacgtattttgaacatttttaacaaatctttatcttcttttatgaactttgcagtctctccccaacatatcttcgcctgatttcttatagttgcagtcatatatgtttgagctccagcataattatcaaagccagtcatatataggcctatgccgctattcaaaagtgatttagaatttttcctagcaagtaaattgaaactcttgttaaaccttctgtagccactttccatatgtatccaaccaaatacagatcctaaaataaaacactgaaacaactttaacttgatcagttttccttttgtgtctgattctccactggtgaatttaagcttctcgaagaatttgagcaccctattggctttatcctcatcaaaaacataaggaaaatcttcagttccttgcctttgtaagtcatccatgtgtcttttacaagataatttaacgagttcgccagctacaatttcaccatttaaaacttttgtagcgtattcagtcactctattcattttatataaactcactaaatttattttcttctattcttgtttcaggaactaccaatttcaaacgagaatttatggtcaaccctaactctgtagactgctttctaattaattcggcatatttggtctggacttgcacatgagggctaacaactgtatttgtgtttcctgtggcattcgtatgttctacagtcgttccatgctcctgaattgctttagaggctttaaggtaattagagtaagcatcacaatacacagccagtgccacagtgtctaaatttgtaactaattctaactcaactaaatcttttatgactcttttccattccttttttgcatctttatcgagccaattcggacatttgattttgtcatttttgggttttagcttactctcgatttcttctctttcagcaatctctgccttagttaaatgcgttttaccttctgcttttattacagaaatcggcttgcttgatctacctgccaatttaccacctccttacaaattcaaaagggaaggtttaaaaaaggaaattcaccgtaggttggggggagtggggtctacagattgttcttttatagagattttagtacggggggtactttcctctactctagatatgctttctgccaacacgtacatacacctaacaatatctttattaaaatgcttctgcttcatttgaggcattgaactatcattcatacgatcaagtatttcgcccaatctttccttagcaagcaaagtatcacttgattctttagtttccactacatcctcttccttcttacgatctccctcaatctgttccttaccctttcccatacctcaactcatcctctctggtctttttattgtggcattcatgacatagcatctgtaggttgtcatagtctaatcgtttactccaatcaatcataataggaacgatatggtcacacacatcagccacgttaagtttcttattctctaagcagaattcacacagattgtttttatctcgcttccttctatcacgaacactcttccactttgtagagttatagaactgttttgatttcttatttcttttatgttgatcatagaatcttctattgacttgagactcatcagcaatctctttatgttcttcacaatacttatctttcgtaaagttaggacacattacctttgcacatagttttagagatcctttcataactattcctcaaactttaatctcaactcatggacacgcaacatgtttgcatcttcaagcgctttgatctttttctggtagtgtttgatctccataacattctttctaacaaacttatcattgtagaagtatctgtactcctcttgacaatgatcacacttgaagtaactcacattagtttcgttgtcgagtttcctttccttaatcgaactgataacaaagtgttttccacatttgtcacataagattcctttgtcgctactcattgtcttccctccaataaaaataaaaaaagcatccaacaggacgcttcagtttgcttcaattactattccagttatcatcttgctgccatcttgtgctttgtcaacacttccatagacagtaatatcatcgcctggtttgtatgtatctgtagttagattaaatacagtaaacgttcccgtttcatttgaaagcattagataatcaagcggactcccgtctttagctacagttacgatatcccctgacactttaacttgatcatcaatggacgattcttcttttaattggtctgcggatatctcttgcgcattttcaaccaggttgcttttattctcttcaacggacgcttcgtcattcgcctctgcttcgaatgaaccttcttcagatgatactgtggtttcttccttaacattctctttatttgattcactctgttcttttgtacccgaacaagcagcaagcgtcataagaatcagaatagctataaacactttcatataatcccctcccaagaagattataccattattcaactaattcaattaagcttactgaatctcttgatacggtgcctttatcatgtttgatcgtttctttaaaaaatgctccaaaatcatttgtatgtaaccgttgaatctcaaaattgattggcttattatcctcttcatcagtattccactcaaagtgaattatcactctatttgtaatttcttcacctttgtagaatacttcaggtattccatcttcttcatgcaatttgatttcaattaacgctggattctcagtcatcgctcgtctcctctatataacatattccgtacatttgcagcagtctcattataagtcttgcctaataattccttgccgaatttaataacaccttctggaacttcctcacctgcatagtaatcaatttcataactactaatcactgttccgtaagtttcgccaccacgataaagtgtatcaactattggtcttacattcccaaagacaatatctccattattatcattgtgctttttatgtaggttttcaaagtaagcttcagtcttctttgattcactcatgaataaattatcatctttgtctttctttaaaaaatccgaaaacatcaaatctaatgtatctcccacttttacttgttcttcaatcacatcattcatttgttttcctccaatttaaaaaagagagcatcatagacactctctccattattcttatgtattttttagggatatgtatttgaagttgttaacgaagtgctttcctaattcagaaggcgttctgtagagttataatggtattgtgggttgtttactcttcttcctttgacgcaaacaccttatcattcagaagaatagctttactcgcatgaaaccaagttgagcccatacatcttccacattccatgtcttcgtctttgaaatagagatcacactttgtacaatatatacctgagtctaatagcttcttcctcatcctacaagcatctctttcttcagtttcttgatgaaataaacttgccctttgcctgtaatacgtggagtgaaactgattctttcaaacgtaccaggtaagtatccagcactctctgcaaacgcaatactctctcttgcatcaatcacacctaaatccaaactcttttgagaaggtctattccaatcctgagttaatagatatccttcccgtctaagccaagctgcgaacttatttcttcccaaaggaataccagcgttcttcaactgagtcgcaaattcccctagactaatagttgctgaagaaatttctattgatacagcaaactcaacctttggagcttgttcttctaataatcgttcgttatatttattcttttcttgttcactcttcaattgagtggccaatctaatgatgaaatcaggattagttaaagtttcttctacagtttgcggagttaaatatccaccgtgcttatgaatagtaggaatgacttcatgagtgatccagcgtttaaattttttcgcttctggttttctgctacttagaactagagaatataaaccatactcatttataatgttggtttcaccagataagccccctaagttgaacttagccacctcgtcataatctaatcgaccaattgccactgttgggttactcaattctagaatctcgcacacgtctttcgctacaaaccatacctcttcattctttacaactgttcttacttgttgatcttcataattaaaaatttgttccattgaaatacctccgattatttgatttgtgcaagcagaaaaagcccttcgaccatttaaggcgggctttatctcttacatcaactcatctaagctattggaggctaaattgtttgccaagcgtatatcctattgaacatacggtacgatagagcgtctcacctctatcccattccctgttactctttttaattattaacagtttaaaaaaataatgttataaccttcataggggagatatactaaccttttaatttggatatttgctttttacctcccttatgacgattatctccaaaagcggtctaaacccttgtggctgtagggctgtagccactttttaacagagtttattttgcacaaaaacgctgtatcccttgtggctctaaggctcaaggcactttctattttaggacaaacgctgttttttcttgttttctctccacgcatctcttagtttaacttgagagcaaggtttacagtactttgttttattagagtttgatttaaccattattccacaacttaaacaaggtttgttcacttttagattgttttggagattagatagaatcacatccccaaaacattcccacagcgtagctttatatctgcttttctttttatatagatgttttacaagaacatctaccacatactgttcatcactatttatttcaagtagcttatctctaatgagtttgtaaacgtacaatttctgatttggcttagtttcttcattgttagtaagccattttttgttcccttaaggcgattatctctaaaagtggtttgagaccttggtacgattggcttaaacatgtttttttcatagtaattttttgcacaaaaacgccagactctttgggagagtaaggctcaaggtactttctaaaccgtcatttttttcctatgaggggtttggggtggtgtaggacgaaagggcaattcaacttgttgaagtgaccaaaagtcagcaccccaagatcttattcagaatagattattatatctatatttgttattttatttttatacctttttcttaagagcaacacccattttagccagtaataccaacggttttcaaattgattatttaagaggtttattctattaaacattcagataactgttccacaatacattcactttgattttattttgtcggtctttttgttttatcttcaagacattatcaaatccataacatgggggatgctttagatagataattttccactgcgttccaaattatctatcgtgcagccaaccatcccccatacccccttcagactgtatatgggattttattttcccttctaaaaaaataatctcaattatgctgattcgctatatttagaataatactagaaaaattcgaccaacaaaggtaagtataattatttggataaggacgtttactggtcgaattttatcaactgaaaattagagctatttcctcattggtcttctcatcaagcgcgctaacgtctatttcccttaactcttctgaaatagattcagcatcatgtttaattaaaatatctatcaatttattaatatcatctatgtattttgactgattcctatatacgttttgagatgaatcaatatgacgtttttttgcgttttgtagtaatctagcacacgctttaatattaatctcttgaatatacttaatgcgagttgcctctttcaaaagcaattccaacatactaatacattcatcttctatgtgcttactgttgagaataatttcgtatacttggaaataggaactgatgttattatataaatataactctttattaacttttgattcgaaatctctccacacctttttcccttttgctctaatttgcgagagcttagtacacccaaattcttgcaatattttcttttgactaaccagaattgcttctgtttctttcgctgttgctactctagaactttgaccattttcgttcactttataaacagttgtgaaatgtatcatgcttctatccgaaaggctatctaaagcagctttgatagtttttttgaagctgccttgacatgtattataaaaatcttgtactacttcactgtcagagccaattaataaagcaatttcgctttttttatgcatagtactaaaataatttttattaacaaatccaagagaactaattaatttactttttgtaatatgaagaagtttatttcttctatattcctgtgctagcatatctaacaaaagccattcaattaattgaatatacacggcatttttagtgtttttttctttcggtaaaggaattgtataacgtgatttaataacaattgtatgccctcgcttttcatattcacagtatcgggctaactcttttaattgagactttttgctattcgtagaatttttataaaccaaacccgtttttgcacacaaatctttatgatttttaaaaattgctcctggttcaagaacttcaatttttataacaatctctccccttattcgatgatagattttttagttttttcaaatttgaatcaagatgcttaagcacatgtatttgatcattaaaaaaattgatttcctttggtgaaatcgttttaagaactttatattgatatgaatccaattcagcagagtcaccaatgtcatctttaataattacatgtttgacgttcttaacttttataactttataaacactatcaaatctaagattatttaggactcgaaatctattgctgaaacatttatccatatgtttttctctattatcaactggaagtatccaatcaccctctaacggccatctgtctatagctctaaaatattgtttttcaccattatcttgaataacttcaacaatctccattgaagagaacctactttctttaaatttggtaattacagtataacatttccatatcaattaatgtctcaatgtaatcattatctaaaatccttcgatgatgcaccttcaccttgatcagataacatacgaggacacttatcatattgcctatcaatgtattttgaagcttccctaatacgtttctttttgtctgattcaacagatttttcattgtcgtttagtttcatttgattctccttttgtttaagatcaaattagcgcacgtgcgctaaatatatcaaaaaggcagggatccaactccctacccttccaatatgtatcgatttatgctccacgccccattcctgcagtatgataatcagctgcagtttgaaccgattgctgtccacctacaaaagatacgaccagtgttgccgcaataacaattccaaataatacttttttcttcatatattcacctcccttcaagttatatttcatttaaatagctaataactctaaaattctctcgctctccccttggcgttctaattcatgcaaaggaagctttatgcaatatttatctcctgcctttttaaaatattcaattgaatcataaagataacccttttcattgaatgctagtgctttgagataaaaatgataacctagatacgaatcatgttgatccattccctctagttctaaaagtatttgctgtgctctaatcatttctcctttattgattaagctaaaagcctcttcttggatatctaatatgttgtctgcatttttaatgacccagggattatcttttccccaaacattttctacaaagcaaaggctgctgataatgtcatcataaaaaatgtctcccttgttgcttctttctaaccccttaagtaagttttccttcgctatgtcataatcttcgaagatatagctattaccaatgttcaaatatgcgtaaacaacaaatcttctaatctttgtttctgcaagagcataaccagcatacattcggcatttctttgtgttgtttctattgagggcgttgttagctaacagaattaacatacgacatctataagaatctctgaagtaggtgtctgctttaagtgcatccaagtctatctcaccgataatctcatccaaaagatcaaaacgaccaagatttaagtacgtgtaaagaagcatcaacctggagaagactttcatttccattgagataatgtctaacttcgctgtcttcttaattgcattaactgtgcttaactctccatttgttaattctctatgtatagtatagacttgagcacattctttattaatacaattcgatgatttcgacaggagcgatataagggcatctgtaagcctgtgatactgattcacgtccgcatactctaatatatctcttgcccaatttgcatcaatgtccagcctttcagataccttcttgatcgtactgggcgcttccttttgccaactttcttctattaactttatgattgaatcaaaaccctcagaaacaactgttttcatagtaaacccccgaatttatttaattagaatagtctggatcaaacatttttatttcggtgtcgatttcttgttgagctaaaaaatttagttctggtgtgtttctgtaatttttaagaaattgaacgtaagcatcaggattattaaaaacaaactctgatctcataataagatttgcctgctcctgtctgtcactcacactcgattgaacggattctagatgttcaagtaaagctgacattcgttaaccccctttaattgtataagggggaagtcccccccctctcttatacagcttctctatttgctaatagatcagcaatgaagtctgcgcctttcggtgtaacaagtgtgattgttttaattccgatattggtttcctgtgttttcacctgaaagaatcctcggtctacatatttctgataaggaacgtttttgtttgtcccactcattaaaatattgttttctcttaaatatttgaaaaggttattctgccccattcctttaatacaaagtactttagctagttgtccaattttcattaacccgtctgcatctaagaattgattgtatttctctaccttaggctctgccaatgacaactgcgcttgtaattcacgcttcgcctttctttcagtgaagtaagcaattgctcgttcttcctcatccagcccaagataagtgtcaattaatgaaggtctagcttttaacgccttctccatttcttcaaatcttgaaacatattgagctgtgaacaatacaccttttgttccagtcattttgttagcaaccatatcgcagcctttacgagtaaggaagaaacatttataaggttttcctgttcctgattcataacaactttcaatgaagaattggtcagcccccaaatttgggttttgacttaaaatattgatatacccattaatatccctcactagatgatcatgtctctttccagtcatctcagccacttctctgctatctaccaaaagctgtccattctgttcaattaccgttaatttattttccaatataattcctccaatttgtttagattttttgcttccaactatattgtccgcaaaagtaaacgttttgttatagttggctttcgtaagacactcgtaagacagttatgtaaaaaagtttatttaattttcaaagatcgtatgtggctttattgttctaagtggagttggagtagtgccagtctatttttctattaaatatgtagaaactgttcatttggatcactccgattatgttatagggtgttgcttatgtatgtattcgttattctgatactccgttaaaccagttgaaaaatgcttttgctggaatacggtatactgtgccaatcttatgcgctgggaaaaatccttttttaacaagatcgtatgcctgtctcttaccaatgcccataaaattctggatgtctttcacttcaagtaccggtttctcaagaattgccgtcaacaaattccctccttttctttttgaactcccctcgtatcctctgggtgtaatcttatagtaacatgataaatatgataacacaatatatttatcataaatataataacaatattatttttatcatcaaaatgatgaaaatatgataattttcgtataattaataagttattgtttttatgatatactcaaaaacagaggtgttaaaaatgacaacgattgaatctttattaaggaactctccatatttcagagtatttttcaaatcatatcgaaaggaaatgggagtcaacgctagagatctatccagagaattaggtaagggagatgcttatataagccaaatagaaagtggtcgaattaagaacattgatgagagcactgcaaggtggctgttaaacaaaattgggacaacccaagaagaggttgataagattgtatacttttatttctacagagaacccagtcattataataatgaagcattgcatcatcgcagagaatcctttagcgaagaactaaataccgatccagcatccaatgatctatataaaagcttgtttgaattggtggatagtatgaggccacaagccactgacgaagatttgaaaagaggagctgaaattttaggaagagtaaattctataaactcaaccataaagatattgatagctgctgatttagaggctgctgacgatttggtgtcaaaactttccgaactgacagctgaagtaagtttccctatattcaacagaaaatctgaagaacatcaaaaaatagcaggggtattattagatgcgaaaaacgtattagaaagcgcagctcttaaaacccaagagaaagaagaacctgaccagagcgagtaatatttatgtaagcaaaggaaagtgatcgggagacacgtaaggaggatactatggcttctatacattcatatgaaaaacaaggaaaagaacattactatgtcatgtacgacatttatgtgaatggtaagcgcaaacagaagaagaaaaaaggcttcaaaaaaaagaaagaggcaaaagagtttaaatcaaaagtagagaatgaaattaacgaaggaacttacattgatccagcaaagatccctttttctgagcttgctgaaaagtggttcaataagaaaaaaataggcttatcaaaacagactattaagaactacagaattaacctggataaatacgcgtttcctttttttggtgatgttgcaatatcaaagattaccacagaggatattgacaattttataggtgacatgcttacaagaaaaaccaaaaaggggaaaataggctatgcaccagaaacaatagataaagcttttgatgttattagtggatgttttaattatgcgattgatcatgaattaattaaaaagaacccctgtgacaaagcaactctccctaagatgaaaaaaggtgagacaagtgtttggactgatgatgaggccaagactttcctgaatagcgttaaaaataataggctatactgtttgttttatatagctttacacactggtatgagacaaggagagcttttagggctgcgttggaaggatattgactttaaacacaaacgcttatcagtcaaacaagtaatgtcgcatgatgctagagagatgtatcttggggctaaaaccgaagcgggtaatagaagtatcgatttaggcaataaagcccttgaagtattaaaagaacatagagcgaaacaagaagaagaaaaagtaaagtacgctgacatatacaatgatcaggatttggtattctgcacattacatggaacaccaatgaatccatctaacataagaaacagaataatgatccctgcaatagaggaaacgggcattactaaaataagatttcatgatctgagacacacatgtgcaacgatattacttttgaatggcgcacctgttaaagcagttagcgagagattagggcatagcaatataaaagtaacacttcaaacttatgctcatgtactaccttcaacaagtcaacaaatagctgatcaaattgatggaattttagattgaccacactgaaagtatagtgtggtttttattttggtaatgttacctttttgttacctttttgttttaagaaatacaaaagccactctcgattatctcaagaatggctctgtatcaacgtcttttcatatgattccgactgggctcgaaccagcgacctctaccctgtcaaggtagcgctctcccagctgagctacggaatcgggttatgtatcagttctgggctttctgttactgacagtctctattatataaccatcatcataagtcgtcaatggttttgttcaaaaaaggtcaaaaagccggcggccgtgccggctttttttctcctttatgattggttgacaagaactggctttagttgatcaagtgcttgtttgaagtcgtgtttgaggtcttcgccgttttcaactcctacacttaatcgaagcaggccatctgtaatccctcttttttctctttcttcctttggcatagcggcatgtgacattttggctgggtatgacagaatggattcgacggcgccaaggctgacggcgaatacaggtaatgtgacagcgtccaccaattctttgacagccgcttggttttctagttcaaatgagagaacggctcctgctccgcttgcctgctttcgctgaatatctgcacccggatggtcatctaagcctgggtagtatacttttttcaccgcaggatgttctttgaggaatgtagcgagttcatatgccgtttggcttgctttttccaatctcacttgaagggtttttaatcctcttaatacgagccagcaatcctgcacgcctagcaccgccccgaaggagttttgcagtgaatagagttcctctcccagcttctcatctttcaccacagctaagcccgacagcacatcactgtggccgcttaaaaatttcgttgcactgtgcagaacaacgtcaacaccaaggtccagcggacgctgaagcgcaggtgttaaaaacgtattatctaagaaagtcagacagtcatgctctttcgcaagctgtacgacaccttcaatatctgtaatgcctagtgttggatttgacggtgtttccatgtaaatgacctttgtattcgattgaatgcctcttttaacttcattcaaatccgtcatgtccacgaaggtatgctcaattccaaaccttgaaagaacttgggtgatcattcggaaagtcccgccgtacacatctcttgtgacaaggacgtgatctccttttgataatagaagaaaagcagtggagatggctgccatgcctgatgcaaaggcaagccctctcgttcctccttccagcgccgcaatcgtatcctctaatgcttgccgtgtaggagttcccgatcttgagtagtcatattggccaaattcatcgaagctgctttgatgaaatgtggatgcatgctgaatcggtacactgactgcccctgttgaacggtctgttttaaacgtattatgaacgagttgtgtttcgaatgtccaattgtgtgtggtcatttggcgtgtacctcctcttttacttgtgatagtgcctgtttcaggtctgctttcaggtcatctacatgctcgatgccaacagagaaacggagcagcttgttacacacaccgtttgcaatgcgaatctcttctggaatatccatgtgcgtttgcgttgcaggatacgtaatgaagctttcgactccgccaagactttcagcaaaacaaatcgtttttagttgcttcaaaaatggattgacccagtcctctttagctactcggaaagacagcatgcctccctttcctgggtaaaggacatcttgaatttctggctgtttctttaaaaacgctgctagctccttcgcatttgcctcgtgctggcgcattctaagagccagtgttttcatccctctcattaacatccatgagtcaaatggagataaaacggcgccaattgcgttttgatgctggaacatgtcttcagagagcttctctccttttgtcaccacaagcccggcgagaacgtcattgtgcccgcctagatatttggttgcactatggatgacaatgtctgctccaagcgtaatcggcttttgcaaaacgggtgtgtaaaaggtgttatcaacaatgaccaatgcgtcatgttcttttgcaaccttcactattttttgaatatccgcttcctgcatcagtggatttgtcggcgtctcaataaagactgcttttgtgtttggcgtgattttagagcgtaaacagtcttcatctgaaaaatcatcgtaaagaaaacgtaagccatactttttccattcgttttcaaacaaacggtatgtaccgccatataggtctgatgagacgatgagttcatcaccgctttcaaatagcgccatgattgtttggatcgcagccattcccgaactgaaggcaaatccggcggtcccttcttcgagtgaagcaatcgcatcctctacaagctgccttgttgggtttttcgttcgaatgtaatcaaatccggttgattcccctatacctctatgtctgtatgctgttgaaagataaacggggggactgaccgtaccagtcgcctcttcgctccggtttccaatttgcgctaatgtcgtttccacatgttctgtcatttgacaccatcctaagtaaaaatctgatttcaaaacagaaaaaccccttcttcataagaagaaggggttttaatcgcttcctcttatcttccaagcaaaaaagctgcttgctggatttagcaccttggtacatcacatgaagtgatgcataccggttgctgaggtttcaaagggccagtccctccacctctcacgataagaatgtgttgtctgtctgttctaattcttaatactgtaacgcattaaatctcatttttcaagaggaaatggaacaattaattgaaattttctgtattttataacagattcggtgttaactgaattgattgcatgttagcatataggaacaacgctatttttcatgttacaatgaatggaaacgtttcactttgtgatgaaatcggttagctggaggaatggattatggtgaagaaaacaggcattattcaagaagaaaccttacattcaaaagaacttggggcggatatgacccttttgatctatttgccagtcaattactcccccctttatacatatcatgtcatcattgcccaagatggtcatgattatttccgtttaggcaaaataggcagacaggcagaagaattgatgcaaaacaaagaaatggaacgctccattatcattggtgtcccttatgaaaatgtcacggaaagacggaatacgtatcatccagatggcacaaaatttgaagcatataaacgctttttagcaaatgaacttgtcccttatattgatacgcactatccgacctatcaaattggctcaggacgcacgtttattggtgattcactgggtgctacaatttctcttatgacagcgatagattatccttctttatttggcggactcattttgcagtccccttacgttgatgagtcagtcttagaagctgttaaacagtcgactgccctttctcattatgcgattatccatcaaattggactggaagaaacggctgtgaaaacgacagacggccaagtgcttgattttattcagccgaacgacgatttaaagacacttcttgaacagtcaggtgcagattatttatttgagacattcgaaggggatcataaatggacgtattggcagcctcttattgcgccttcgttaaaaagaatgctcccatattcgttaatcaactgaattttgttataataaacaataataaatactttcttaatcaggagggaacaagatgaaatacggagttgttatatttccatcaaaaaaattgcaagatattgcgaactcttaccggaagcgttatgatccgaactacgcactcataccgcctcatttaacacttagaacaccttttgaattaacggatctagaagcggctgaggtcgtctcaacgctaagagagtatgcaaaaaatgcttctcctgttacattacgtattaaaaaattcagttcattcgctcctgtaaacaacgttatttatatgaaagtagaaccgaacgaagaaatcatggcgctcaatgaaaggttgtatgcagatccacttgagggtacacctgaatatgcctttgttccgcatgtgacagtggctcaaaaactatcagatgatgagcattcagacgttcttggcacattaaagctgagaaagattgaccatgaagaaacagtggatcgcttccaccttttatatcaattagagaacggatcttggaccgtctatgaaacatttattttaggagaagagggttaagtacatttgaaaacagtcattgcaacagcacaaacacaacgagaagatgcatattacgttcgaaaagaagtattcgtcaaagaacaagaagtcccgttagagattgaaatagatgaactagaagacgaggccattcattttgtcatttataatgatgaaatgaagcctcaggcagccgctagattgcggatcattgaaggaccaaaggcaaagctagaacgaatttgcgtgttaaaagaggcgcgcgctttcggccttggccacaaactattagaagcgctggaaacagaagccattgcgaatggagcgaaggaagcggttatgcacgcacaagtccaagctcttcctttctacgaaaagaaaggctacaaagccgtatctgaaccatttgaagaagcagggatcacacatgtcaaaatgacaaaaacgctgtctgtttgaccaaaagaaaaagccaggacatcatggatgatgctctggctttttctttatcatcgttcgtcaatggaagaaagcgcaatcatttatatatacgtattaatatgaacgcctttgccttcctccataaacatatctcgtacaaagcgttcccgctttttttgctgtactttcgtttccgcttctgtcactaagtcctcttttttctccagctctctgtataccttgtcatgaaaggtgcgagtaaccttagttactttcgcgtagtcttctttatcctgaggagcaggacgattgatatattgaaaatacagatccggctgaatcggggctatatatcccatcaagaacgcctcctttgcttctcttctactctactattccctaataatgactgtttgaaacacgtctaatttgatatgattagatgtgtttctttttaagattgattaactattggaggactagctttgaaatgcgcacgacgacatgatcgaacgatctcattacatacgtattcgagagaacattatcaattcctccatgacgagggaaaaaaagggcacttattctgcccatattgcggacaaccagtctctttcagattaaatatacatgaagaacctgcctttattcataaacatacgtctcagcaagagctgtgtgaacaagcagaagaacaagaagatcagaaaaaacacgcagagcgagaggaaagtgctgcttataaagaacttgggggcttccgttttccaacaggtaaacaaatcatctcgcaaacgaatgaatcatatgactggcaggaaccaaggtcgattcaatttagcgatgtgatacatttagaagaaaatgaacaagcacataccatcgatctctttccgcatatcacctttagcacaccgcagcttcaagctgtcacacataaagacggtccgatgcttgtgctggctggtgctggcagcgggaaaacaagagtcctgacagcaagagcggcttatctcatgtcacatcatcatattcctgctcaccatatcttactcgtgacgttcaccacaaaagccagcagtgaaatgaaagaaagactgcgcaagcaatatcagctgcacccatcacaagcaagccaagtggtgacaggcaccttccacagtcttttttataaaatgctgcttcacgatgacgcaaacaaatggaacggccagcacctgatcaagtttgattggcagaaggaacagtacattcggaaagccatcatgaatgaaagactagatgaaaaagactaccctaccgatcaagtcctgcaatcgatcggctattggaaaaatgcttttttaccaggcgatcttcctgatttgaaggatgaaaaggaaaaacacatgtggacgatctatcaatcttatgaacagcaaaaacgagacaatcagcaatttgactttgatgacatggccattgcctgcttgcacatgctgactgaacagcctgaactgcttaaacggtatcaagaacggttcaaatatatattggtggatgaatttcaggatataaatccagttcaatatcaattgattcagctgttagctggagaatctgagcagctattttgtgtcggtgatgatgatcaagccatttatgcctttaggggcagtaatcctgctttcattcttgaatttaaacgagattatcctttggctcagattgttcatttacatgccaattaccggtcgcatcatacgattgtcgcaagtgcggatgccgttattaagaaaaatcagcatcgttatgagaaaacgttaaaagccgtccgatcggagacaatccctcctacgctcttttatccatatgacgaggaagaggaagcgaccatgatcgtgtcagatattcaggagaaaattaaaaacggcgcaaagccgagtgatatctgcgtgctctttcgcaccaatacgggaggccgcgcgatttatgagcgtctgcatcaatccgcgattccgtatgagacggaggctggtgtcaaagccttctacagcagacgaattgttcgggttcttctcgcctttctctctttaagtcaggatgccgatgatgtgtccgctatgaaacagctgcttccggttttctttttaaagcagcagaccttaaacacaatgaaggcactaaccatcacagaagattgttcaatggtcgacgcactcggaaaaataacagatattcagccgtttcaacgaaaaaagctgcaatctattgttcctctgttcagcacgttacgaaatttaaagccgtctgacgctgtggcgtttattgaacaaaagatgggacttggtgatttcttaaaaaaacgagtgaacgatacgaatgtacttgaaaaaggggcggatgatgtacgagatgtaaaaaccgctgccaaacgctttgaaacgattgaagcctttctctcacatgccgaacatatgaagtctgccgaaaaggaaaagacagtcgaaccaggtgttcagctcatgacgattcaccgtgcaaagggactggaattccaaacggtgtacatcacttgcgtggtcgacggagcactgccacatgatttctcactcgatgaactcagaaacggtgatgaagaagccttggaagaagagcgccgtttattatatgtggctatgacaagaactgaacagtctctttatctatcggttccatcatttagacgagggaaaaccgctcatcgctcgcgctttttatatcccctactaaagaaaaatcgagcattattcacagaaaaacaacaggcccccctttaagcggagagcctgttgtttattttttgttgttcatcattttagcgatggtattgaaatcaagcttttcttttccacttgtaatcgattgaacgattttgtcttccatttctttaggtacacgtttgttcgcaagctgcgctacttttttaatgacacctcgaaccgttgcttcatctttaaagttagcattttgcaaagaacctgcaagtttaaagacatcgttcatattcacacccgttttattttcaacgcttttaaagaatttattatccattcatttgcctcctctttatggagtaatcaccttactatatgaaaataggcgagatatgtgcctatcctaaagccttgtttgcccaaagagaaaggaaagcaaagggctcccccattgcttccctcaccttcttactgtttagttaaagaaagaagcaccaacgatgattagaaggatgaaaagcacaacgacaagaacaaatgttgatccatatccgccgccgtaacctccgccgtagccgccgcaagaaccgccaccgtaaccgtaacaactcatatataagcacctcctcttctcccttacaaaatatgaaaaatactacaaatggtttggacgatcacataaaaaagtgcggaatttttatttctgctgtttaaagacgtaatctgcctctccatgacgcacaatgaatgcttctgtttctttcgcaaaagcatccatcttctcgccaaatgcctttaagtgctgctcaagatccttcgctttatccgctagatccatttcacccttttcgtgcgcttgctctttcccatcatggggtttagtgaacaaggagccgattaattgttcgaatgcatccattctggtcaccccttctctcttacatatgcatcactcaaaaaaagggcaacaaaaaaaccggataaatccggcttttgttttctcttctattgaggtttctttttgtttccacagccgcagcctgcttttttaattttcttcgtataaacagattgttgatttgactgcgctggataaccttgaagcgtatgtgatggcgtttcagttggtttcatcgcaacccttcctttcctattccatgatagtatatgcattttttgaaagcgtgtctgatcagaatgcctgtttatttcaccagctttgagacaattgcttcaataatgcctgctgctgctgcaatggctaatagtaaattaagccacatgctgatgacaggaaatagtatgtatatcagaagtaaagcagcagtgcaccacataccagtacaccaataacagcttaacagctctcctatccaagaccgcagccctttacctttaatgatgatatatgtctctacttcaccttgttcattgatctcttcttgttcttcatgaaataaacggcggaaaggagcagtaatggtatcaaacacaatgagcctcgtcagtctaaaggatgcgagggcaaacacgacaaatgacaaagcaccgctcaggagcctccacctccttctttctcctttttttcgtcctttctttatatatgcaaaaagaaagacctccatgatgaatcgggcggaaataaaattgggttgtactttttcacactttccgattccaccttgagcctctgctgcattaaataatgtatagataagaaaggagtgaaagtattgtctattgaagaaagtgctgatttattatacacacaactattaaacgaattaatcagcaattatgatgatttcattgaaatcaaagattccgaaaatgtcacgattcataaaacagatgtaacagccgcactctcccttcaagcgaccgtaacgacaatcattactcttttaatccaacttcttgtaccagacgatgaattggctgcagatatcacagatcagcttttagccacacaacaagtgacagtccaaaagaagactgtgattcaaatcatcaattgctataacgtcacgattacactatctgatgcatccattatgaactccgtacaaattctcactcaaacattgaatgtactattagttgaagccggcattctttgaccctttctttttctaacattatgtatgaaagaggtgaaataatcgtggctgaagagaacgaaaaaaaggaatttcaaatcaacactgaggttgatccattaacgagtcttcttgtgagtgatattttaaacaaaaacaatatcacagatgatcagaaagcaaatatttcagatgatcaaagaagaatgattttgaaattagttgaggacttacaaaagaaagcagatgacttcgtacaacagcagcaggagaaaaaaaggcaggctgagtcagcaaaacatgtggaagaagtagcccctgaaccgcaagtacgtccaaaacgaaattcacttcgagatcgtattcaacagcgccgtgatgcgcagcgaaacaacgattaaataaaaatgggttgcgtgatagggtaaatgcctgagacaaaaccatgcattccagcatttaataaagtaaacggaaggaggaatagaaatggattctaaaccatattcttgggtcgctctagatcgtaactgtacacaccacggacaccacggcgattacaactatgaaagaaaagcagtttgtgacggccactattatgatgatgaagatgtcttacaagactttgatcaagtgagttttacaaagcagacgtctgaggaagtcattatcgtcagagactcttgtgacattaacgtctcttctgttgacgcacaggttgcagcatctattcaagtagctgttcaaacagcgatcatcaccattacaaacatctcaatcgcagacggtgatttagcagaccgcgtcacacaagatcttttacaagccgctactcacaaacaaacaaaccgccagaaacttgtcattgaaaactctagaaacgttacagtatcaacaatcgatgcggatatctcgatcgcgattcaaacacttactcaaacacttgttgcgacaatcgttgcaatcggtatcctctaatgtccaaaagcagagcgaaaagctctgcttttccttttataaaaatacaacaaatataaatagtcatttacccacaccaactagagggcgcatacatatgttgttaaggactaaagtcaaataccttgttaaaggagctgaaatccatgagctgcggaaaacaccatggccgacatgatgaaaactgtgtatgcgatgcggttgataagattttagcagagcaggaagctgtagaagataaatgtcctacgagctgctacagtaatttattaagcccgacagtttctggaaaagatacaattccgtttttactttttgataaaaagggcggattgttttctactttcggaaacattggaggatttgttgacgattgccaatgcttcgaatccattttcttccgggttgaaaaattacacgactgctgtgctacgttatctgtattaagacctgttgatgtacacggacatacgctaagcgtgtgtcacccttgtgaccctgacttctttggtctagaaaaaacggacttttgtattgaggttgatctaaactgcttctgcgcaatccaatgtttaaacccagaactagtagacagagtcatgccatcgaaagataaaaagcatcatcaccacggctaaatcaatcgtccgttgacctaatttgtcatgagtcaaagcatccccttccttacgaatgacagtcaatcatgcggaacagtcagcataagagctgccgcttccgcattgattgaaagtagaagtatcaaccggtaaaacaaaaagcttgtagatgatgacagtgctcaaacactcaaacaaatttcctagtataggagggttgaatatgagccgcaaacattcatggaattgtgtagcagaggctgttgaaaatattaacgacttacaaaatgccgttgaagaagaatgtccgaccagctgttacagcaatctcctttctccatcccattcattaggtgacactgtcccgtttgttctctttacctctaaatcaaaaccattcgtcgcattcggaaacgttggagaagtagatgcaggtccttgctttagcactacatttttcagagtcgaacacatctctgaccactgcgcaacactcagcttgcttatcgcatttgacaaagaccgtcatattttagattttacagataaagattccgtatgtgatgtgttccgattagaaaaatcgaagtattgcattgaagtagatcttgactgcttctgcgcaatcgagtgcttaaatccacgactcatcaaccgtaactgctaacaaaaaaagtccctctatgggactttttttatttgttaaaaaccaagtggatgaatcgaggaaatttcatctattgctaattcaactggatttcccccgcccgctgttcgaatgaccactgtatcttcttgtcgatccatgataatccctctataagttttaccatcagcttcaatcaggcaaagggctcttggcatattatgaggcaggcttgtgagaaaatcgactttttcgtcaatgctcatctgacttaaaggctttttcactcgttttcttctaggttcttcttttgtttcatgaaatacaccttctggcggcttttcctcttctcgctgggattttcgttcttgtataagttctgtttcttttgagatgtcttgttctttggtaagctctgcttcttgcatcatgtcttgttcttgctgacgctcaggcggctcagcttctcttttcttctcgatttcttgagccacgggatcctcgtgtgtaccctcttcgatcttgtcttttttactcttagaaatttcttgtggtttttcaggtttctttcgctttctcacaatattttgcatggccggcattgattcatcatagctcggctgaacaatatacataagcggtttctggttctcatcacctttatttgacatactaatccctcccgaatgattcattccttatatatatgagcggacgactcaaatcagaagaaaaataaaaaaacagcatacccttattcggtatgctgcaaatcatttagttgtttagcgggcaatgatatggaagccagaatcaacatgcagattctcacctgtcatgccgcgtgatagatcactgaataagaatagcgctgtatcgccaacttcttcaggagtcgttgtacggcgaagcggtgcacgctcttcaatatccttcagaatggtattaaagccgctgatgccttttgcagacagtgtacgaattggaccagcagaaatactattcacacgaataccttctgcgcctaaatcagctgctaagtatttcacacttgcttcaagtgctgctttcgctacacccattacgttgtagttagaaaccacacgctctccgcctaggtatgtaagcgttacgatgcttccaccttctgtcatcaatgggcgcgctgcttttgctacagctgttaaagagtatgcactaatgttgtgcgccaaaaggaacccttcacggttcgtgtttaagtattcaccgacaagctcttctttgtttgcaaatgcaatcgcatgcgcaacgccatgaatgacttgtactttttctttaattgtagcgaaacatttttcgatttcttcatcacttgtcacgtcacatggaagaatgattgaatcatcgcgctcaagtgtgcttgcaagttcttttacagattcagcaagacgatctccaacataagtaaaaatcaaacgagctccagcttcgtgaagtgagcgggcaattccccatgcgatgcttcgtttgttggcaacacccattaccacgatattacggccttctaaagaaaagttcatatgtaataaagcctcctattttttcaagacatagtattagtacctgatcataatattatcacagatcatgaaagaatgacaatttccgctgaaagaaagtttctttttcatcaaaaaaccgtccacacgagtgaagacggtttgactttattatcgtttgagccggttttgctgataagcaaaatggttggtaggtccgtttccagctccaatattcaaagggtacttgatggcttcatggacaaaggtttctgcagtttcaaaagcttctctcatggaatatcctttcgcaatttcagctgttaatgccgctgcaaacgtgcagcctgtgccatgtgtatgcggggtatcaatatgttcgtttgtgacttctataaagccttttccatcatacaacaggtctgttatcataccgccagaggggccatgtccccctttgatcacgacatgtttcgtaccaagctcatataaacgctccgctgctagatagcgatcctcttttgtctgaatgcgcatgcctgtcagcacttctgtctcaggaagattcggcgttacggcatagctgacaggtagcaagtgtgttttcatcgctaagaccgcatcttcatttaataaagaagcgcctccttttgcgatcatcactggatcgacaatgagcttcatgtcatattgaaccgttttttcagcaactatcttgatcatatctgcactccacagcatccctgttttgacggcatctggcagtaaatcctctgccactgcatcaatttgactttctaacgcctcgattgaaagcggatataccccatgaacacctagtgtgttttgtgctgtaatcgctgtgattgcagacattccgtacacaccgagctcctgaaaggtttttaaatcagcttgaatgcctgctccgccgccagaatcagaacctgcgattgtaaatgcttttttaatcgtcatttcatcacacctctcattagccaatccattgatgataaatggttcttgcttttgccatatcatttgtgccatggacaagggctctgccgtctttaaataagacaagcttatattcatccttttgacaggaaagcaaatacggattttcaaggacatccatccctgctttctttaaccgaagagccacttcgtgtaacgaaggcggagtttcagctgcactgcggatttggactgtattgcggccgcatagtacatctgcctttgctctcttgtcataggagagaaaaggatatgttttcattccgcagcttggacattgttttttctttaaggaactggctgatcggatgtcagaccgttcattggtccataaatcaaacgatcttaatatcggcgtcacttgatgacccgttaaatacttcagggcatctgccacttgatatgctgccacctgctgcacaactggactaatgataccggctgtatcacatgtcattccctgtgcgggtaaatgttcaagaaggcagtgtaaacacggtgtttcaccaggaatgacagtaaattgaataccatagctggcaacgcaagctccataaaggaatggaatttgatgtttcacagcagcatcattagcgatcattctcacttcaaaattatccgctgcatcgacaatgattgaagcgccgctgaccagttcgtcaatatattcagcggtcacatcgacgacgattcccttgacctgtacgtcactatttatctgtttgagtctattttcagccgccacggcctttggcagccgatcctgcacatcttgctctgtgtaaagctgctgacgctgaaggttgctccactcaatataatctcgatccaaaatggtgacagatccaacgccagcacgaacaagcatttcagcactagctgtcccaagcgctcccgcaccaataatgacagcctttgagtcatttaaccgcttttgcccctctgtgccgattggctgaaagagctcttgacgtgaataacgagtgctcaaaatgccggcattccttcctgcgggctacttgctgtcccgtagtttttcaatggaatgcgtcctgcctcgaagcctagccttcctgattcaatcgccagtttcatggcttttgccattttcacagggtccttagcgcctgacacagctgtgttcagtaatacagcgtcagctcctagctccatcgcataagccgcatcttttggagagcctacaccagcatcaataatcactggtaccttcgcctgctcgataataaatgagagattcagagggtttagtaagccttgccctgaaccaatcggcgaagcacctggcatgatagcatggacaccaagctcttctaattttcttgccagtaccacatcatcagatgtatatggcagcacgataaatccttcttcgagtagcatttcggatgcttttaacgtttcgactggatctggcagaagagaccttgagcagccaatgacttctaccttgatcatgtcacacagtccggaagccttcgctaagcgagcaatacgaactgcctcttctgctgtacttgcaccagctgtattcggaagcagcgtgtatttagataaatccagctgttccaaaaagttaggctgagatgcttcgaaaatgttcattcttctcacagcaaaggttaatatttctgcttctgatacgttcacagcttctttttgaatttcaaatgatgggtacttccctgtaccaagtaataatctagatgtgaatgtttttccgccaatatgcagcatgttgtcatcctcctcctacaaagtgaacgatttcgatcgtatcattaggttgaattttcacttgttgaaacgcttctttatcaataatttcttggttcttttccacaatcactactcgattttcaagctgatagtctgatagcaggtcatagatcgttccattctcttgatcgaaatcaacggttctgccattcaattgaattttcatacaaacagtgcctcctttcggtcaatacgaaatgcgtgaagccattcttttttgaccggttcacctaatatcaggtcgcgaatgatctttccagtaatcggagcaagtaaaataccatttctgtaatgaccagtagcaaaaagaatacgccgatcttctggatgtcttccgatgtagggatgctggtcgcttgtcgcgggacgaaggccagcccagcactgatcaatcggcatctccttgatcgaaggcatcagctgtgacgccttttgaatgacagcttcgataccgccaagcgttggaacagtttcccactcgtttggcttcatcgttgcgccaacgatcagtttgccgctatctcgttgaacgatgtaacaatgatcatggtaaatggtgtgttggagtgctggaccatgattccatacagacacacattccccttttactggataaagagaatgagataatccaagctcttcaaaaaaatgaccagaccatacaccacttgctacagttagttcatcacatgtgaatgttcccatcgttgttctaattgctaacgcttctttctcccgcttcacttcgattacgggtgtacactctttcacttctgccccgtatctgaccgccgcctgccaaaatgcccggcataccgcataaggttcgacatgaacatcctctttaatcaaacctgcgcctaagatgttctctgccatttggggcatgcatttttttacgctgcttgcgtcaaaccaatcaaatgtagacaaatgctgcatccggcaaagtgcttgtttctcctcttcggtaaaggctaccttcatgataccgcccactgatgttcgaatatcaatgccagattcatgccgtaaatcgacttttaacttctcgtacaatgcctggcttgctctgcctgcttgaaagaaaatatcctcatgaccctctccttcagcatgtgcaccaagcatcccagcagcagcacttgtcgtttgcttccctgcctcattcgcctcaaataaaacgacctgctttcctgcttttgcaaggtgataggcaatggacatccctatgattccaccaccaatgatcgccacatcataatgcttcttcataaggattctcctttacttgtttagaaaatgcttgtgccatcttgcgcggctgatgatgagtaaaaattccagacatgacagcaatccctttcacattcgcttgtctcaattctggaacgcgctcaggtgtcacaccaccgattgccaccactggtatagacagtacagatgtcagttcttccacaagctgtatgcctcttgcctgaagtcctggtttacaagtggtgtcatatacgtgcccaaacatgacatattctgctccatttttctcagctgctttcccttcttctatcgaatgaacggagacacccacatgaagatgagggaattttttccgcagctcttttggcgaaaagctatggcccgggagatgtacccggtgaatattggtgagcagcgcaacgtctactctgtcgttgatcatgagcttctcttttggtacaccttctaaaaggagacatttcacgatatcaacaagctcacttgctgttttagaccgttcccgtatatgaataaaatccacttcagatacaatggctattatttgtttgatcagctcttccgcaggaagcgaatcatttgtcactgcgtggagttccatttgcaccaaccccatctaagcatgctgtttgccacatttctttttgatacgccatctcccagaaatggtattcgtaatagctagaaatcacaaaattttctttcatattggcctgcacatgttctggtgctttttcggctagttcatcaaagcggttgacctgttcaaagacgagctccttaaaccaatcccctccatatgtcaaaatccattcttgataaatcggatggtcaggtgtggtttgtttcagcttttcacccacctcataataaagccagtagcacggcaataacgcagccaatatctcttcgaatcgtccgcttttcacagatcggtacatatgtgaggtatacgcgtaagcagttggagatggcttaaagttctcgatggcttcatctgaaatctctaaaagctctgtaaactttctatgcagcgacagctccgcttcatacgtcccctgcgcatgatatgccattctgcccgtcgtatgtaagtcctcactaatcgccgctccatatgcttgcacctttgcaaaatgagttaaataatatgaatcctgcatcacgtaataagtgaaacgatcgagtgacagcgtgccatctccaatccctttcacaaaggggtgtgtaaagcttccattccaccatgttgctgctgcttctttacattcagttgaaaacgtcatgtttctctcctcctgtttttccatataaaaaaaccactttccatatggaaagtggcttggaatttgtcaaaagcataatcaaaaaccgcaccacttccctacgcaggtatgaacctgttcaggtaatgagggtctaaaagtcaatacttttatctcagcccttttaaaggactcccctagtggatcaaatatatgatgttgtacttctatcttaatcaggaattgttcattggtcaagggttcattgttactctaattgggctcttagtcctgccacatattcacgagagcccgacacaagcacacggtcgccgcttctaagcgtcgtatctccatgtgggactaaactgtctacccctctgaaaatacggacaaagaccaaatcgccggtaaacggaaactccctgagcatgacattgtgaaagcgatgattgttcatttgaatttgatacaaggaagtatcctcatttgttaataatcgaatcgcatctggtgcttcaatcagagctcttagcaccgttttagatgataggaaattagaaaacgtatcaatgcccgcttccttcaatgtcagctctgcctcagctttattcacactcgcaataacttgttttgctccttcttcctttgcaaataaagcaatttccttattttttgtctcactgcctgttgcgacgacgaggacatcctcccggccaacgcctgcctttcgcagcgtctcatcgtcgtacttctcaatcgattccacttcaaagatggagtcggcaagcagcgcttctttattttcttgaaagacatgcaaaattcgaatatcatattcatcctgatgtaaatcgagtgtgacaggtaaggtgagctgatttgcaccaataaaggtcacacgttttttatggctcgcagcttgttcttttttaaacagcgctttaaaccaaacaggcgttaaaatactcgtgagtaccgcgactaaaatcagcgcgccagacattttgtgatcaatgactccaagccgctccccgatcgtcgctgctgcaatgacgagtgataacgtcgatgttaataaaaagccagagccgatcacttttttcatgtcataccattttttcaaataaaggatcggaatgagcttactaatcagtaatgcaataaatagcagcgggatcatgatcataatggttgggtccttgaacagtgcccatatattcaaatcaactccgaccatcacaaagaagatagggatcaaaaatccgtagccaaatgaatccagctgctgaacaagctctttattcggcgaaagaagagacacaagcacacctgctaaaaatgccccaagaatattttcagcaccgagtgattcagataaggcaactaagactataatgagagtaaagatcgcccttgtcccaatttgcacggtcccttttgacatggactgaaaaattgactttgtcttaaatacgcggccaaataaataaagaaggatgcctgcagcaaataataagagcagaagccacatattccctgtaccatcgccataaatggaggaaaatacagcaagtaaaatcattgtcaccaaatcagcaatgacagcgacaagcaagatgatttgaccgatattcgtctgcatcaatttttcctcttttaaggtgggaaccactacccctaatgagatcgtcgatataatgagcgtcattaaaaaggcattttggataaaccctgcaagaacaaacgcataagacaggataaaagaaatactaaatacgccaagaaaaacaatagtggctgcaataaacgtatttggttcttttagaccatttggcagttctcgtgctttcttctttgactcgaaagaagaaaaatctatttcaagtccacttaaaaacatcagaaaaataaaaccgagcatggataacgtatctaaccacgcatcatgttcaacaaccagttgaagaccgctttttccaatgatgagccccatgatgatctcagcaacaacgaccggaatggtcagcttaaatcggtgcaataaaagtggggtgaaaaaggcaacaataataacgacaacgagtgatgaaacagatgtatgctccattggctaaagcctcctaacattgatgtttaatcttttaaggtttacgttaaagcattgattctaacaattgcctaaatgaaaagaaagccattcgttatatgttctaaaattcaaacttctttaaccccgatgaacggatgagtaaaatcaggaggaaatcttatgaaatttgatatcattggtgatatccacggctgctacgaagagctgcttaccctcatacacaaactaggatacgaactcaaacatggattacccgtccatcctgataagagaacgctagcacttgtcggtgatttaacagatcgaggacctcagtcagtagatgtcatgcgctttgtcattcatgcctacgcacacggcgcgatccgctacgtacctggcaaccattgctttaaactatatcgctatttgaaaggaaatcccgtgaaattacttcatggcattgaaaccacagtgaacgaaataaaaatgcttccccttcatgaacaaacgaaattgtcacatgaatttaagcagctatttgagaaggctccgctttacgatgtacttattcctgatgaactaatgattgctcacgcagcgatgaaggaaaaggacattggtagaaagccgaacaaacagatgcgatcctatctattatttggcgcagtcacaggagaaacatggccggatggacgacctgtgcggaaggattgggcaaaggaatatcgcggaaaaccatgggttgtctacgggcatacaccagtgaaagaaccgcgattcgttggcagaaccgtcaacattgatacaggctgtgtatttggccaccggctgtctgcccttaaataccctgagcttgaaacggtttctgttccatcctctatgccttatgacgattcaaggtttcagcatttcacatcataaaaaaacccggtcctgagcttgcaggtagccgggtttctctatttaaagcagcaatgatttcatgtcttcaggaagcggagccgagaatgtcatttcctccccggtcatcggatgaggaaagacaagagtctcactatgcagtgcctgccggttcatctgctcactcgtcccgccatataacgtatctccgatgagcggatgaccaagatactgcatatgaacacgaatttgatgggttctccccgtttcaagtgccagcgtcacatctgacatcttcaactcagcgtccaccgctcgcactgtaaaatgcgtcacagcttcctgcccagtatcatcgaccattcgctcgatgatactatctccttttctggcaatttttgcacgaatggttccacgcttttctttgatcaagccatgtgtaaacgctctgtatgttcgtttgaccgctccacttttctgcgcttttgataaaaggctgtgggcaaagcgatgcttggccacaagcatcacgccagatgtatcacgatcaaggcggttcactaaatgaaccgtcagccgaacagactgctctgcataatgatgcagcaatccattcgcaatactgtgctctgggtgctcccgagaagggatagacgggatatatggctttttattcagcacaaggacgtgctcatcctcaaataaaatatcaagcggaatctgagcaggcttcagcccttcactcactttttcctcggggaataaaatagtgagcctgtctccgttatgcagcttgtatctcacagtcacatgctctccattaatgaggagatcaccgccatcaaatttaatatccgtcagcattcttttcgaaatgccaatatctattaaataatcctttaaaagcagcccttcttctttggctgtcatggttttgtttagtgtaaagtattccagcgagaacgacctctttcttattcaccttttccgataaaggaatcttgcacccttttccaaaacggaaatggtctaaatcgggcaaagcggacattctcgtctgctacccggcattgaatggatttgacgtccttatgaagcagcgtcaaatgatcaatggttacctgaaaatcgacatcattcctcggtttaatgacacaagtatgatggtctggtaaaataagcggcgaaccgaccgttcgaaacactctgttgttgattgaagccatttctgccagctgaatggctctaatggaaggatgaataatggcgcccccaagtgctttattataggctgtactgccagacggtgtagacagacaaagaccgtcacctctgaatgtttcaaacagctgacccctaatttcaacatctgccacaagtgtcccttccatacttttaatcgtacattcattcatggctaaatatttctcttctctgccgccgtcgttgtatctgacaatgacttctaagattggatattccacaatgtgataaggtgttttcgctatagctaagacgagtttttcaatttcacttggcacccagtcagcataaaaaccaagatgacctgtatgaacacccacaaaagctgtttcattcagacggtcgctataacggtgaaatgcataaagaagggtgccgtcaccaccaaccgtaatgacaagatctggttcctcttcattgagttccattccgaaatccaataagtaggtctgaattttatttttgagtgtgtcagatacagaattccctttcgaagaaactgcaaatttcatgaattcttctccttttccaccttgctgctataagagggcagcatcatatttgatcaagcacaggctcagctatcgtttttctttttccgggaaaatgctacttgtgcttcttgaatttcccctctaatttcggacatctcatcatcaagaagagatgctgcctcagaagctctttgaaggcgcagcttgactttctccgggatattcccgctatatttataattcagagaatgctcaatggtcgcccagaaattcatcgcaagtgtacgaatttggatttcgacaaggagctgtttctctccattgatcgtttgcagcggatataacacaacaaggtggtacgaacggtatccgctttctttatgctctgcaatatagtcgcgtttatcaacaaccacgaagtcttttcgtgactggagcatttttttcacgacttgtatgtcttctacaaactggcacataatgcgaagcccagcaatatcctgcatcgtttcaatttcatgcattgggatgtttttacgctttgccttttctaatatgctggcaacgggtttcactcggcctgtgacaaattctactggtgaatggtcatcctcgaattcatacagctttcgaatgccttttagtttcacttttaattcttcgactgcttgtttatacggtgcgaggaattgatcccattgttttttgtccatgaaacttcccccaattccatatacctaattatttcagaggaatgtgctcttcactttctcttccatatctccgtaattggcattgtctttaatattgtcgattaaataatgtaattcttgatgaagctgaatgagttctaacgaatggcctcctgctgtcaaatagacagggatgtcaagattcattgcttcttttaatggagcccatgtatgttcccctaagataagatatgaaaaggactcctcgttttcaagtatgtaaacgaacgcaaagtgatcagaatcaacaagcatttgtcctgatgcttttgctttttggatttgctcttctgacttggtcgtcaaaatcagcctgtcttcttttaaagttgcttctgcgatttcaattcggttttgcatcatgatctcctttacaacaaagtacagctttattttatcatatcaagttcaatattgataaaccgaactttttgagaaaatcctattttcttcttataaatgatcctttcacgtaattatccattgattttggtacatgcggaaagagaaataatagataaaaactgtcttttacatgatgaacatacttcatgtacaataatcatatttcctctaaatgaaaggttgatgtcaaaatggcccaggaaattgaaatagaactaaagcaattgttaatgaaagaagaatttgaacagttgaaacaacattttcaattgaaggattcggattttcacacacaaaccaactattactttgatacaccccaatttgatataaaatctcaatttgctgcattaagaatgagagaaaaaaacgatcagtgggttctcacgttaaaggaaccacacgaaataggcttactcgaaacccaccaaacaattgctcctccttcaagccttgacgattttcagctgccaaaaggtgaagtggctgacaggctagaccatttgaacattcaaaaggatcaaattgtgtattttggttcacttgaaacgtcaagagctgaaaaaatgatcaaagaaggcttaattgttttggatcacagccgatatttaacaatagaggactatgaacttgaatttgaagtgagcgacctggaaatcggacaagccgcattctccgcattgctccaacaatttcaaatccctgtacgaaacacgaaaaacaaagttgtacgtttttatgaagagaaaatgaaaacacagaatagatgaattccttgaaggaggaacaagatgaacgtcaatcaaattcaatcctttatgcagctccaagcgcttaaaacgttacaatcagaccctggacaaacgcaaatgccgggcggccaagaatcgaatgcacaagcttcatttcagtcgctgctgcaagattttttaggcggatcagaattatcacgcctgccgctttcaatttctgcattgatgggaacggacccttcaacggctccgaacacgcaatacgcgcgtacaaacccatacttatctgctatcgctggtggtgagcagcttcaagctcaaccttcatatgcaaatgacgctcaattgaatacagcaaatggtattggaaatgtcttaaacaacagctacacgccgccgcttcaaaaggctgtttcaagcggctcatcatcaaaagaaattaatcaaattgtgtcacaaatggctcaaaaacatggtgttccagaaaagctgattcatgcggtcattaagcaagaatccggctatcgtacgaatgcggttagccatgcaggcgcacttggcctcatgcagcttatgccttctacagctaagtcccttggtgtgaataatgcctttgatgcggcccaaaacatcgaaggcggtacgaaatatataaaacaaatgcttcagaaatataatggaaatgtctcactcgccttagctgcttataatgcaggctcaggaaatgtcgataaatacggcggcattccaccatttaaagaaacacaaaattatgtaaagaaaatcacagcacaatatttcgcttaaaccgaagagaataacctcttcggttttttgtatgtcgcttttcacccttttttgactgaatgtgttatgatatggtcaattgatcacggaacccgcctctccccttatttccaatagaccaaagcggtttgtttgtggaattgagttgaggttgttaaaataaatatacaagaatagaaacaataaaatagaacaaactgaatatcacttttgaaataaatgaattcacaatagggcgcttcatcctattaactacgagtaaaaggagtagtcaacatggtacaatcgtttaacgcaccttacgaagcggttggagaggaacttctatcgcaacttgttgatactttttatgaaaatgtaaagtgtcatcctttgcttcatcctattttcccggatgacttaaaagaaacagcaagaaaacaaaaacagtttttaactcaatatttaggcggacccccgctttatacagaggagcatggtcaccctatgctacgggcgagacatctcccttttccgattactgaggagcgggctgacgcatggcttgaatgcatggaggatgcaatggatcaagtaggattaaccggcgatattcgtgactttttatttgagcggctctctttaacggctcgtcatatggtcaatcaaacacctgaaaaggatggacgatcttgagctgcaatacgcacgatcaatatttctcacactgtcacggacatcctcaaaagccgattgaaatctatgtattcattgaccctctaagtccagactgctggttattagagccatccattaaaaaattgaaaatgaagtacggccgttttttcactttacgaacggtgacaagctctagtattaatgcattgaatcgaaaacgaaaaaagcatttactcaccgaagcatgggggaaattcgcgaccaaaactcagaccaaaaaagaacaaatgctgtctgaacaaattgtgacctcaccctatctcgcctcgcttgcattaaaagcggctgaacttcaaggcagaaaatgcggaatgaaatttctgcgtctcattcaagaatcacttttttgccatcagcaagatgtcacaaatgaacatgtactgctagaaaatgcaaaaagcgctggactagatatcgaggaattccagcgcgatattcattctcaaagtgctgtcaaagcactaaaatgtgatatgaaaattgccgctgaaatggacgtgtctgagcttccgacctttgccttttttaatacagtaaacggagatgaaggattaaaaatttcaggtgcgtactcttacgatgtgtacgaggaaatcctttttgaaatgattggtgaaaaaccaaccccatcagtacggcctccaattgaatggtttattgcttactttcaatttgcatctgccaaagagattgcggtcgtatatgacctgacacttgaagaagttgaacgagaaatgaaaaagctggctttcgctaaaaaagtcgaacgtgtacaagtgcatcaagaaatgttttggcgctacaaagaagatgatcatccttcagatcttgatgtctatcgctgtgagaatgaacatgggtgctgacccatgttttttcttcacctcaaaaggaacactcgttcttttttaaaccacgaagaaaccgcgccgggataagcgcggtttcactatgtcttaacgacaacaaaggggatgggagaaatttttcacggtcaaacaaaggggtaatgtttgtatgtgattaatttcacatctgtagtatatcaaattttgtcgacttatgacaacagatatactatatgttcatatttttgtcacaaaacataagagggttgtcactttcatatagtgaaagtaacgaaaaaatggagggatctgcatgcgcagcacaaccattggacttgtttccattggcttatgtttctttttaaatatattaggcttaatgaaaatgcttcctctttatctcacatcgcctctcttatttgctgcaatactttttacactttatcgaatgaaccatcggaagacctttaagggatttaaaaggtgatgataagaagcggcctctacatgcgaagaggtctttttttgtgagaaaaaaactcctgtcaaaagatgagtttgcactcacacgtctgacagaagtcttttcattactcacccgttttagagatgagctcctccatttcttttaatttttcttcgaacaattgacatgctgcttcgattggttctttggaagccatatcaacacctgcttttttcagcacattgattggataatcagagcttcctgctttaaggaagtctgtgtagcgctccaccgcaggttttccttcttctaagatttgcttgcttaatgcctgtgctgcactatagcctgttgcatattgatatacataatagttgtaatagaagtgagggattctcgtccattctaatccgatttctttatccacaaccatgccgtctccaaaatacttcttgttcaggtcgtaatagaggttcgtcatgaattctggcgttaaagcctctccttcttgtgctttcacatgaatcagatgctcaaactcagcaaacatcgtctgtctgaataccgttcctctaaatccttctagcaagtgatttaacacatacaaacgctgttttttatcatctagatgattcagcaggtattcgccaagtaacgcttcatttgtcgtagaagctacttcagctacaaagatgctatagtttccatacggatatggctgatgctttcttgtatagtagctgtggacagagtgcccaaattcatgagccagtgtaaataaattatcaatgttattttgccagttcatgaggatatatggatttgtgccatagcttccagatgaatacgcaccgctacgtttccctttattctcataaacgtccacccagcgattattgagtccctcttttaacacggatacatattcttctcctaatggtgctaacccttttagcatataatcctttgcttcatcgtaggttagcttcatgccagcatcttttacaagtggcgtatacaagtcatagttatgcacttcatcaagctttaatacctttttacgcaattcaatataacggtgtaataacggtaaatattgatgaacggtatcaattagattgtcatatacttcttctggaatactgttccgagatagtgctgattctcttgccgatttataatttcgtacttttgcataaaaattatcctttttaatcgaaccgctcagtgtcgaagcaagcgtgtttttatactgatcatacgttttatacacagctttaaaagcattctttctcacttcacggtcatcactgtttaaaaatgtaataaagttgccgtgggtaatcttcttttcttccccattttcatcctttacagaagggaacgaaatatcagcattgttaaacatactaaaagtagtagatgaagttgagagaggttcagatgcctcagctaataaggcctcttgctcctcacttaaaatatgtggacgttctttattaatttcttcaagagcatgggaatacagttttaattcttctttttccaaaataaactgctgcaatttatcttcttgaatcgataaaatctctggaacaatataagcagaagtactagaaagttgtgtaaataaattcgatgctttatcattcagcgcttgaaatgatgagttcgttgtatcctcatcgtatttcatgtgcgcatatgtataaagcttaccaagcttttcagaaagctgatcctgaaaggttagggcttcatacagtacatcagcagaatgggcgagcttgcctttaaattgggcgagcttaggaatttcttttttgaccgcttcgaattccttgttccatgcatcgacgctttcaaaaatatcttcaagccgccatttgttttcttcttttacttcgcttctgtctggtaaatggttgtttttgctttgtgaagtcatatgaatcccccttgcataagttgtgttgaaccaacctttcggaaagtgaaagaaattggtgttgtatttatcttctttgttttgaactatatttgtcaaatcatatgcagaaataaataccaaacagactaaaaaaatgagaaaaaagcgtttctttctattcaatcgcagcaccacctttttcttatcatgatcaaagtgggcatgaaacatgctaatgaaataagaaagcatctcgtttgaacgcttcatctactgtttgtatcggcagttgttttgacactacttcataattaccctctttcgtcatgtacaaaaacccttgtctgacaagcgcatgaacatatgaggtgataacctcttttatttcttctattgaaacatcgccatatcgaagctttacttctttcatctggatacaccgcttcatttctttcatcagcagttgaatcgtcactggactgctacctttttttcttatgatccaatcatatagacacccctgccagacataaacggggcttgtaaagatgtacgcttctggcagcgggataaataattcagccggcagaaaagggaaagctgtttgatgatgctcataaaaaatgtctcttaatcgtttgctttcatttgataaaatacgaggtggccgctgtctaaattgctgtatacatcttagccattgcttggagacttggcgcttgcttgagggctgcgataggatatctgaaaattggcggtatgctgttggcgatctgacagtcataacggcacatatttttgttggttgaaatacaaggaattgagcaagatggatgaatcgattctgaagcggacaataaaaaatcaggcttcctttctgtgattcccttaacattccccaatgaatggaggagaaggaaaagagctgggcagattttcgctttaaacgatttgctcctatgatccatatagggaagtgccctgcttgacggagtcctgctgtccttttacttagctcttgctgcgaaatatttgaacattgatattcgattgcatagcttgttcctccaatagagacggccacgtcaggacgctgatgaacctttgacacatacttttcaagcaccggtttatgcccaagccgctgaagccaattcataatggcttcttttccggcctgatgataagccgtttcgcctgaggctagtggacatgcagtgagctgtttatgtgcaaaatgataaacacgctgttcaccaagctttaattgcacttcttccctgcattctgggcagtaaaacttgcacgtcgtcctgacatgctccagccggtttttagataaatgatgtgtaatacgaataagcttaccattatccatgatcgctgtattcattcagctcgccccttagtctttgatgaccgtattatagcttgttcatctataagagagcgaataggcaaaatgaacttttatggtgtgaaaatatgattttactgatgttttactgaggaaaatgaaaaaccccctctgataaaaagggggaaaatacaatctttatagtaatggcgataataatcttgctgttgattcaaagagccttacccttaacggtctctttgcaaattcttctgggattatctcgtgtgactgctctaaatcacctaagaagtcgtttacgagcttctcagtgcttctcgttttgtagaggaaggcattcacttcaaaattcaaatgaaagcttctcatatccatgttggccgttcctatcgaagccagctcgctatccacaatgataaatttactatgcataaagccttgatcatattcatacacctttgcccctgcttctaaaagctccgggaagtatgaacgggacgcatggaagacgatccgtttatctggattcttcggtgcaataatccgtacgtctactccgcttaaagcagcaattttcaatgcagacaaaatatcatcatccggcacaaaatatggtgaagcaatccaaatagactttttggcagagataatcatggagaaaaagagatttttaatgacctcccactgtttatcagggccaccagcgatcatttgtacgccttctgttgtactttcaagatggctgaaatctttaaagtagtccacacctgcgcatctttcattcgtcatatagtaccaatcctgcatgaaaatctgctgcagatcacgtacagcttcacccttaatcatcaaatgagtgtcacgccaaaaaccatattgtctgcttctgcccaaatattcgtctccaatgttcagcccgccaacaaatccaacttctccatcaatcacgacaatttttctgtgatttcggaaattgattttattatttaacagaggcagcctcacaggtaaaaatggaacgatctgaacgccagccttttcgaggtcagcaatatattgacgagagagcttcaaactccctacatcatcatataaaaagcggacaatcacaccatttttcgctttatcaatgagaatatcctttaattcttgtccaaggtcatcatgacggagaatataatattctaaatgaatgtgatgtgtcgcctttttaatttcttcaaaaatatgagagaatgtttcttctccattggtcaggactttagaggacgtgcgatacgtaataggggtatgtccaagtctgtgggccagcttaaataagagctgctgatgatcacccatatgtgtcattttctcaatcgcttctctatgaatatgttcatcttcctggattaactgttcgtccaggatggctttcttttcaaacagccggcgttttttgatattgcgtccaaagaaaatatagaacagaaagccgaataacggaaagctgccaagcaggacaagccacgttatcgtttgagatggattccggttctccaagaatatgacaaacccaatgaagataatcgataaagtgaatagaacactgacagaacttaatacactgaccgctaaatcaccagcaattaattgaatgactaaataagcacctatcgtaatgataagaaaaaatagaactttgactaaatttctcatttcattttctccttgccgatctctttatttacctattcattcagataaaaaagccgattcctctatagaaatcgacttttgttggttacgagaagtgctgttgaatcgtttcaagggcatttccttcgataatcagctgaccgtattctttcagtctgtaaatgctgaccactgattcatgagcatattcaagtaaaatgctgagcttattctccacttgctcatctgacaaatcctcgtggaagtcaacatatagataataacggttttcaaacgaatataaacttgtggtaaaatcctgcatatttaattgagaaagtgcaatcaaatcttcaaagtcatccattttcaacacaaattgaagttgaagttttttgtccttctcattatgatcttcttgatcctgctcttctttttgaaaatcatcaagcagtgcatctagactttcttcatctgtttgatcttttttatcttctggaatcggcaattcgagcttttgtccatctttagaaagttgggctttcgtcacgacaatttcaagacctttgtcaagtgcctgcacttgaatccaaagcggcccctcaactgcaaattcttcttcttcgtgcacttcgtccattacttcccaaaacagctcttcactgcgttcacgattataccaaatctcttcacggtcaaatccgcggtcttcaatatcaccgtaggaaatataaaatttcactgtatgttcattaattctttcgatttccattttgccaaccttcccttctatataagatgttgaagggacatacaagctcccaattaatagtactttactacactttacccgttccgtctacatgttaaccttttaaagaattgaaggtatcacttcgtactgtctattttatgataaaacatgaataaaagaaataaaaacgcattttttgcagagaaaacttacagaaacatatatttgaattgtcctcatatattggttgtacgagctctattagacatgaggtgaaatagatggaaacagagtggatcatatccttactgatgattattggcattgatctgattttaggcggagataacgcattgatcattgcgatggctagccgcagcttgtcaaatgacaaacggaataaagccatatggatcggcacacttttggccgtgctgatgagaattacaatgacaggtgccgcagtttatttattaaccatcccttatttacaatttatcggcggactttttctcctttatataggatacaatttgttaattgaacaaaagaaagaatcgattcgcattaaaagcagcggctccctttggcgtgcggttcagaccattgtgattgccgacctctttatgtcacttgataatgtgattgcagttgcaggggcggcaaaaggcaacatgctgctgactacttttggcctgatgatttcagtaccgattattatttggggaagtaaactgattcataccgctctaaccaaatttccgtatcttttatacggaggaagtgctcttttggcttttactggcggtgaaatgattgttcgtgatgtgaaattgaatgaatttatggctcagcatgcgactcttgaattgatgcttccgtttttaacagtcgtcatggtcattttagccagcctgttttacgaacaaacggctgaaaacaaataaaaaaagctgccaaatcatcggcagcttttcgttttttctattagttagcaagtcgctgtgcttctcttagttggaatgtacgaaccgttcttggaaggaaacgtctaatttcatcttcattgtagccaacttgtagtcttttttcatccaagataattggacgtcttaaaagacctggatgctcattgattagtttatacaattgttggagaggcattgtctcaacattcacatttagcttttggaatacttttgaacgtgttgagataatttcatctgtaccgtcttcagtcattcgaagaatttctttgatttcatcgattgaaagaggctctgaaaagatgtttctctcttgatacggaatattgtgctcttctaaccacgctcttgcttttctacatgatgtacagcttggtgatgtgtataatgttaccataaatcttcactcctcaatttgtagaatgaatattgatctgtattcttaaattaaaattgttctaaataagtaatctttatagtgattatactataaaaaagtaagtgtgaacagattttcttgcaatttttgtgacaaaaactagacaatttcattcattttctcgtgttgcttgatgtctgaacattctcatttagtcgagatgatcgaaaatatttttttgttttctattttcaatgaccttcaatacatcatcaacatcttcatacgactgcccataccattcttcatctttatacgtatggattcgttcataggttttcctcattgcctccatcatttcttcttcattatctgtaagaggcgaccaataaaggatttccatgcggttcacttcatttgttgcaagtgacctgcgtttataaccgattgattctgcatgcttgaagtgctctctttggtaaaactttagtcgttttgcagtatctgcatcatcttcatctacaggctcaacctcaagcaagatcggtttctttttttccttcagcttatgaatgagctttgatccgaggccttcacctcttgcatctctggaaacaaataaataatcaataaagataaaattatcaaattcggcgtacatcatcacatgatgaggtccttcctccttatgataaacatcacttctttcctttaataaagcttccatatgctcttttgacttcatttcttctatcgggaagtattcactgagcttttcataccaattcatggatccgctccttatgatatcgttaagaaccacttccttagatattcccgatttcctgctatttaaacgcctgtactagtaagacgcagcaaagtctcctctagtttcacttttttttcaaacaacagaaaaaagttttatatcgaacgttccatgagtaattgaaaacagacaaacaggatgagtgtcatcccggtttgaaacatgatgaaataaaggtacttcctgcgacgtgcttcctctttctgattgcttgttttccggtgaagcatatattccacggaaaaagacacgatgccaacgagcaccataaatatgagcatccactgtcctccatttggctttctcaaaaatgacgttgaaaaaagcatgaatacaatgagaaagtgaaagaatgaatagcgaaacgtcttccatatcgacatctgatttcctcctagaacccgcttgttgttaactagaaattaccatcatctcgtttttttgtaaaataaaaaaagaagcactgacatagcagcgcttcttccttcttatcattgttttgcctgaagctctttgaattcttcctctgtgcagctcacaaagtgacctggcttcacttcacggaactcagtgtttgttcctttgtgaacagatggatcatacttgatccgtttgcggttacgctcataatctggatctggaagcggaatcgcagataataatgattttgtatatggatgaagcgggttttcgtataattcattcgctggtgccagctctaccaatttcccgaaatacatcacgccaatacgatcgctgatgtattttaccatggacaggtcatgggcaatgaataagtacgttaaccctttttcttcttgaagctctttcattaagttgacgacctgtgcttggatcgacacatctaatgcagagattggttcatcggcaatgataaaatctggttcaactgctaatgcacgggcaatcccgatacgctgcctttgaccaccagagaattcatgcggatatctgtttgcatgctctttgttcaagccaacagtttcaagcaattggtacacacgctctttacgtgctttctttgttttcgcaagaccatgaatgtcgatgccttctgcaatgatatcaagcactgtcattctagggttcagtgaggcatatggatcttggaagatcatctgcatttgacggttgaactcaagcattttttgtcttgatttcttcccgtgtacactttcccctttataaagaacctcaccatctgtcgcatcataaagcctaatgatggaacggccagtagtggatttaccacaaccagactcccctacaaggccaagtgtttcacctttataaatatcaaatgaaacgccgtcaactgctttcacagtccctcttgctgtatggaaatgctgctttaaatttttgatttctaacagtttttctgccatgctattcaccctcttttactaatacaggtttttcgtagctaccttctagttcacgcattctcgcctttacagaagcaggcggttcaactttaggtgcattcggatgaagtagccatgatttcacataatgcgtatctgatactttgaacattggcggttcttgttcaaagtcaattttcattgcataatcgcttcggagtgcaaatgcatctcctttcggcgggtttgtcagatctggcggtgttcctgggattgcagtcagctttccttcatctccgccatctgtatcaaggctcggcattgacgctaaaagtccccacgtatatggatgttgtggattgtagaaaatttcatcaaccgttcctgtctcgacaatctgacctgcatacataacagctacacgatcagcgacgttggcgacaacacctagatcatgtgtaataaagataattgacgtttccaccttttgctgaatttctttcattaattctaaaatttgcgcctgaatcgttacatctagtgctgttgtcggctcatcagcaatcaatagctttgggtctgctgcaagtgccatcgcaatgacaaccctttgtctcatcccgccactaaattcgtgtggatattgcttaattcttttttcaggcattgcaatcccaacaagctccagtaattcaatggctcttttttcagccgcttcttttgaaatttgttcgtgcttgaacagcacttctgtaatttgtttcccgaccttcatcgttggattcaaagaagtcatcggatcttggaagatcattgagatgtctttacctcgaatgttttgcatttgtttttcagttttcttaacaatatcttgcccatcaaacaggatctgtccacgcttgaaataacccggcggcatcggaattaatctcatgatggcctgtgatgtcacacttttaccagagccagattcacctacaatagcaagtgtctcgcctttatttaagtggaagttcacaccacgaatagcttgaacctctccaccatatgttttaaatgagattgcaaggtctttcacctctagaatacgttcacgttccatcctaatcactccttatttacgcaacttcggatctaaagcgtctcttagtccgtctccaaccacgttaaaaccaaacattgtaatacagataaatgcggctgggaaccataatctccacgggtagtacgtcatggctggaattccgtcagacgccattgttccccagctcgctaatggctgaggtacaccaagccctagatagcttaagaatgcctctgtaaaaatagcagaaggaatggttaatgtcatcgtcacaagaattggtcccattgagtttggtattaagtgtttaaataaaagtctagatgttttcgcacctaatgtttgtgcggcaagaacgtactcttgactcttcaattgtaaaacctgtccccgaacgatacgtgccatgttgatccagcctacaactgtcatggcaaggataatcgttaataatccttttggcagaacaaccatcattaagatgaccattagtagtgttggaattgcccataaaacgtcagcaatacgcatcatcacttcatctgtacggccgcctttgaatgctgcaatacttccccaaataatcccgatgatgacgtcaagaatagctgcagcaagaccgatgaagatcgaaattcttgccccgacccatgtacggacaaacatgtcacgtcctaaatcatctgtaccgaaccagtgctcttttgaaggcggctggtccgcattcagtaaatcagtcgttgaataatcatacttagaaaaaatcggaacaaagatggccaacatcacaataataaaaatgattgtaagaccaaccattgcaagtttatttgcacggaagcgaagcatagcatccttccataaagatagactaggtttagaaattttttcggattctgctgcgtcagctgtcgcaggaacaaataaatcttttctcatctcttccatgtgttagacccctttcttcgccttcgtcagtttaattctaggatcgataataccgtagaggacgtcaacgactaaaatactaattaatagaataatactgtagaagactgtgacacccatgatgacggtgtaatcacggtttgtaatacttgtgacaaagtgagagcctaatccaggaataccgaaaatcttctccacgacaaaactacctgttaaaactgaagcagccattggtcccatatatgtaatgacaggtaacaatgcgtttcgaatggcgtgtttaatcgtcacagctgatttcgttaatcctttcgctctagccgttctaatgtagtcactgtttaaaacttcaagcatacttgaccgtgcaagtctagcgataaatgccataggcatgaaggaaagtgcaatagaaggtagtacggtgctggcccaagtctcccatcctgcaactgggaaaatcgctataacgcttgcctcagatgcaaatacatattgtagtagcgcagctaaaatgaaacttggaactgaaattccaaagatcgttaaaatggcaatcgtatagtcttgccacttgttatgatagagcgctgcaaggaccccaaacaatacaccaaatgctaatgcgaggagaattgcctcaattccgagggtaaaggaaacggggaatccagaactgattaagtcatttacagtttgtcctttatatttaaatgagggaccaaaatctaattttgcaactgaacctaagtagcttacatattgaacaaataagggcttgtccaacccgtagtgctcgtttaggtttgcttcaatttcagcaggaagtttcttctcaccagagaatggaccacccggtgctgcctgcatgagaaagaaagttgcagttacaataacaaacagtgtgattaaaatatatattaatcgcttaccgatatatttaagcaacggaattgcacctccatgattttacaacattttctctaatcagcaagaaaggtatatggagagacatcctccatataccttaagatccttgccgtagatctcttacactataattcttacttttcgaaatgtgcccatttgtattgaacatcacctagtccagatacaaccacaccttttagttttggatcttgtacccaaagctgagtgtagaagtaaattggtgctataggcatatcgttgacgatgatttcttctgcttttttcagcatttcttcacgcttcgttttatctgtttctttcgcagaatcattcaacaattgtttgtactctttgctttcccatccagtgtcgttgtttccaccgtctttatctttgtaaagctcaaggaagttcactggatcgttgaagtcacctaaccagcccatacgtccgatttggtaatctccactgtggattttgtcgatgtatacgttccactcagagttatcaagttcaactttcacacctaaatcttttttccacatttcttgaattgcttgtgcaatcttttggtggccttcatctgtgttgtaagaaagtttcaatgctggaagatcagaaacagacttataacctaattctttcgcacctttttcaagaagttttttagcagtatctacatcgtgatctttgaagtagccagttttgttatcagtgaatccttccattgttggtggaacgattgccatagctggaacttgttcaccttgcgtaattttgtcaacgatcgcttggcggttgattgagtatgcaagggccttacggatgtttgcattgtttaaaggttttacttctgtgttgaatttgtagttataaataccagcgatcgtttggattttcagaccgccttcttttttcaatgtttttaaagactcagttggaaggcttccagttggtgaaccagcccagtcaagctcgccttttttgaacatgctaagctcagtgtttgtatctttgatcatagacatgttgatttttttcaatttcacagtatctttatcccagtattcattgttcttttcaagcgtgatagaaccgccatgtttccatttagaaagaacgaatggtccgttagatacgtagttttcacctgcatttgtgtaccagtttttattcttttcagccacttttttgttgactggcatatacgtatagaatgcagttagttcagtaaagaacggtgttgggttctctaactcaacgacaagcgtctttttgtcttttgctttaatgccaacatcagcaactttcgctttccctttgttcgcttcttcagcacctttaatatagtaaagctggtaagcatattgagattcatttttaggatctaatgcccatttccaagcatattcgaaatcttcagctgtgacagggtcaccattagaccattttgcatcacgaagtgtgaatgtgtatgttttaccatcagcacttgttttgatatcagaagccattgcattttctggcttaccttcagcgttaattcttgttaatccctcaaaagtctgacggatgacacttcctgaagttgaatcatttgccaatcccggatgtagagaaaaaggctcagtggagatattcacatttagtgttgttttagcctctccagaactgctcgtgctgtcgcctgatttgtttccgctgaaaccacaagcgcttaatacaagtgtgaaaataagcattaaagtaacaacagaccaacgctttttcaactgtattcccccttataatatgttttagttcaaaggtctcgatagaagatgagattcagatttaagaaatagcgtaaaaaagtccctaaatagcttactttctatttcttttgttttttctgaattttcactatgtaaagagcctagcacaaacgtgtgaacaaattaattataatgaatagaataatttattgcaatatcaatttcatatatttttaaaaaacgtaaatggggataaagagggatttttataaactaaagtctcaatcacttcaacaaattaaagcggaaattgattaaaataatttaacaaattcagcaggaataatgttttatacatataattaatcatccctttttaaaaaattgtgacagatagttggtattttacctaaaattttaagtgtcaaacgacatgatgagaaggtcacataaggggcttcgtgacttttttatggtcatcctttataatagatagacatactgttgcgatgaaaaagaagagtacatatattcaccattaacagagagtctgcggccggtgcgagcagacaatggcatatatggaatgggctttggagcagctaaccgaacacttttgaaagtaagtaggcttagacggagcagtctccgatatcaacgtcttgagtgatttccatgtgaaataacaagggtggtaccacggttcattcgtcccttttctgttgaaaagtgacgggtgggcctttttatattgaggaaaagaggttttagtatgacaaagaagacgattttttcaggcattcagccgagcggttctgtgacattggggaactatattggagcgatgaagcaatttgtcgatctccagcatgattataatggctacttttgtgtagtcgatcagcatgccatcacggtgaatcaggatcgtttagcccttcgacaaaatattagaagcttagcagctctttatttagcagtgggacttgatcctgagaaggcgacattgtttatccaatcagaggtacctgctcacgcccaggctggatggatgcttcaatgtgttgcttatattggggaattagagagaatgacccaatttaaggataaatccgctggtaaggaagcggttgtttcaggactattaacgtatcctccattaatggctggcgatatcttattatatggtactgatttagttcctgtcggagaagatcaaaaacagcatcttgaattgactagaacgcttgctgaacgttttaaccgaaaatacaatgacatcttcactgtacctgaagtgaagattccaaaagaaggcgctcggattatgtctttagcagatccaacgaaaaagatgagcaaatccgatccgaaccaaaaatccttcattactttattagatgaaccaaagcagcttgaaaagaaaatcaaaagtgctgtgacggattcagaaggcatcgttaagtatgacaaagagaacaagcctggaattgccaacttgctgacgatttactctgtattaggtaacatatcgattgcagagcttgagcaaaagtatgaaggcaaagggtatggtgagtttaagggagatcttgcgaacgtcgtcattgatgctttaaaaccaattcaagatcgatacaatgaactcattgagtcagacgagcttgatcgtattcttgacgaaggtgctgaaaaagcaaaccgcgaagcaaataaaatgctgaaaaaaatggagaatgcaatgggtcttggcagaaaacgcaaataaaaaaggcttgcagcacatcacgctgcaagctttttctaattcacctttgattcgttttccatttcccaaagcttttcaaaaaacggctgtcccttaatcattttttcacaaaatgttaaatgattttctgaccatccatcaatggtttcattgtaaagcatgttccaaatctcttcgaatgacattcgtttgatttgattgtacatgcgagggttccattccgtataccaatacgcaatctccgccctgttttgaagaccttttaattgatcgagcgccataaacatgagctgcttcaactgtctttcttttctcgttaatccacagatatgctgcggcggcaaagacaaaatatgatactccttcgctgactcaagactgtcctgagagaattcatattcctcagccctcacatctttcaccatttcatacaccaattgctcctgccttgggattaagcggcttttcctcacaggaatggaatacccaatcgtatccacagcaataattcgtataccgtccgtcaccacaaaacaatactctaatttgcgccgttcatgattttttcgaatatatgatttctcaaatactgcttctagcagcgtctttggcagttctgaaagatcattctctatgtaatcatacaaaggactctgcaccttgagtaaaggtacttgatctaacagctccacgctgtcctccttacgccactcatgaaaatgacacacattgtagccattttcttccccttcaaaccaattcacccatacgtcatgaagaaataacataaccaatccctcactttataaaaactgttgtccacagtatgggcaagagatagagaaattattccaactttattaaacttcaagctgagtgaatgatggcatgcttttctttatgacataaagaaaagaaagggtgtcgcagagtccctttcatcttgtcatacaaatgaggcattactttaactttttaggatcaagtgcatctctcagcccatctcctaagaaattaaagcataaaacggtcagtagaatcagtaaacctggaaacaatggataccaccacgcctgcaccataatcgagaaattttgtgcatcttgcagcatgttgccccagctcgccgttggcggctgtatgccaaaccctagatagctcagcgttgattcggctaaaatgacggaacctacttttagtgtagctgacacaataataggaccgatacagttcggtaaaatatgcgaaaagatgatgacatggtttttcgttccaatggttcttgctgcgagtacgaattctcttgttcgcagtgataaaaattcactgcggattagtctcgcggttgtggtccatccggtcaaagcaaagattaaaatcaatttatcaatacccggtttgaaaatggtaacgagcgtgatcaagagaaaaatatcgggaatcgacaacacgacatccacaaatctcattaacaaggaatcaacaaatcctttgaaataccctgctaccgctcctaccacagtgccaatggtaatcgcaccgaccaccgagacgaaaccgactaataaagagaccctcgcgccatatagcacccttgagaaaatatcgcggccaaacttgtcagttcccatcaaatgctcagcacttggcggctggagccgttttaataaatcttgctgctctggtgcgtaaggggcaatcactggagcgaaaatggctgaaaagataatgaccaataagatcacggagccggcaaccgccaatttatttttgaaaaacttctcacaaaataaacgcagcatcgtctctggctttggcggaagaccctcctttaatttgagatcaacaggaggtgttcccatattaggctgtgccaactgtgcttcagctcccttctaatattcaatacgcggatcaacgatcgcatagagaatatccgcaattaaatttccaaccaccacgagcactgcggaaataacagtcatcgccataatgaccggataatctctcgaaaaagcagaatcaataaacagcttccctagccctggccaagtgaaaatttgctccaccacgactgcaccaccaataaaggatggaatcatcaatccgaaaatcgtaatgacaggcataagaccgtttcttaacccgtgcttgaaaatgaccttgttttctcgaaagcctttcgctcttgcggtacgaatgtaatcctgcctcatgacatcaagcatactcgaccttgtgtaccgagtgagccctgccatatcagccgttgctaaaacaaaggctggtaaaatgatgtgatggagccggtcaaacacattaaaatcggcattcaaggtagagactccgccagttggaaaccatcctaaattcacagataaaaccataatgaggatgagtccaaaccaaaagttcggaatagccagtccgataaaagatgtaactgtaatgccatagtctagctttgtatatggacgttttgctgaaagaacaccgaatgggatggcgatgatcaaggcaactaatgtagaaaagatcatgaggatgagggtatttggcagccttgcaaaaatcaaatcagccacaggcgttccctttttaacaatggaggtgccaaaatcaccttgaagcatattgccaagccatttcatatattgcacatattcaggatcgttcaagccgtacttatcaataaaagcttcccggtctgccgcactaatggttgggtccatcataagtgacatcggatcgcctggtgctgctttcatgatggcgaaggacaaaatggtaatcccaaataagatgggaatggaaagcaatgtccttctaatgatatatgtaaccatatgcacaactcctttttcatcggatcgccatactgtgatgaaaaagggctaaaatgatctttcttttagccctctgtcttcattgcatcgtgatatgaaaaccctctcaatctaactggtgcacggtgaataaaattgtgagcgccagcacgcctgattgacaccgaatgaaagggatctgagagaactttcctcttctttcactagcagcctactgttcaatccaccatttctcgattttgtaatactcatctttcgggtggtatgagtagccttggagattagatggcatcgcgcgatgtgagttggcatagtaaaggaacgtatatggttgatcctctgcgatcagttcataaattttttcatatgcctttgagtattcttttcgatcacttaaattcttggcatctactaacagcttatcgacctctttatttttataccaaatgttattcaagcctttttctgactggcttgagtggaagatgctgtattgatcagggaatgtcgcaaggctccagccgagcagcagcgcatcataatcccatttaggcggtgtcgtctgttcaatgagtgcgctgaattccacaatttgtggcttcgcttccacaccaatttccttgagctgctgctggacaacgacagcaatgtcttcacggactttgtttccttggttggtctttatgacaaaggagaattttttgccatccttatcaagatagccatctccatctgtatcctcccagccctcttctttcagcatctttttcgctttttcttgatcaaactcaaatactggaacacgatcagtctttggatagttccatgacagtggactttctggaatgttggctactttgccgtctccatccaacacttgatcgacaatcgtttggcggtcaatggcatgtgtcagcgcctggcggacctttttacttttgaagagttcatttttctggttccagccaatgtatgaataattgagtccgagatcagattcaattttaatgttgctgactttttcggctgtttgcagctcagatcccggtaccgcaaagaaatcaatatcacctgctgaaagctgggcgattgctgcgttctgatcaggaatggttttaatcgtgacggtatcaagatatggacgcccatcccaataatcgtcaaaggcttctagtttcacgtagtcgccttctttccactcggcaaatttaaatggaccagaaccaattggtttttttcggttaaattcattttcaccgagatcctttataggcacatcacctaaaatatgcttaggtaaaatgccgtagcttcctagtgtgacattataaaaataaggatcttttttattgagcttgaattcgattgagtaatcccctgtctttttaacagaatctaatacttcaaagcctgatccgcgctccccgttgtagtccttattgatcggaatgctgtatgtaaacacaacatcatcagctgtcagttcttctccatcatgaaactttacgccttttctaatggtcacatcaaactgcttgccgtcattagattctttaatatcttctgcgagtgatagctgagggttcagctttccgtcagtttgaagtaaaaagctgtagattctttcttcaatatctgagctagccacatctgttgaataaagcgagttaaataatgttggttctgcaatggaaccgatgacaagatctccgccctgcacaggtttaccggtggatttcttttcactgtctccagaggttttatttccactagagcaagccgcaagcatgagcgtgaagatcagcagtaaactgaacaatatagattttctatttctacctttcatatacaattccccctatccttttttaaaaatgacgacagatgccgcttcatcccccctctcaaagatgaattcatccaagccgattaagcgtcgtagaggtgacaggcaacgaagtggtttggttttaattcttgaaatgctggtattttttctttacagatttgtttcgcatgcgggcatcttgtatgaaatacgcacccttttggcggatttgcaggacttggcagatcgccttgaagcatgatccgttctcttttgatctgaccttttttacgggtaacagggacagaagaaagcaatgcctgtgtatatgggtggagcggttcatcgtacaagctgtgcttatcggcaagctccatcattttaccgagatacatcacgccgactcgatcactaatatgcctgaccacacttaagtcgtgagagataaatagatatgtcaggtcaaattcctcctgaagttcctccatcagattaatcacctgcgcctgaatggatacatcaagtgctgaaaccggctcatctgcgatgatcatttcgggattcatggcaagcgcacgagcaatgccgattcgctgcctctgcccgccagaaaattcgtgaggatagcgatttgcaaagcttggatgaaggcccacctttgataaaagctgttctactttttcatttctttcttttaaggaatataagtggtgtgttttgtagggttctttgatgatgcttcgaagtgtttttctagggttgagtgatgcaaagggatcttgaaaaaccatttggatgttttttcgcgttgattgtcttagctttgattctgatacgcgggagatatcttgccctttaaaaaggatttgaccgtcagttggctcatataaacgaatcatggtccggcccaatgtcgatttaccacatcctgattcccccactatccctaacgtttcacctttataaatcttcaaatctacgccgtcaacagctttgactgcaccgactttcttctgaaagacgcctgctttaatcggaaaatgttttttaatctgtttcagttcaagaatggtttctttctctattagatctgttgcatttggctgattttgagcaagggtcatgttcggtctgcctcctcatataagaagcatctgacgcttctgccattttcaaaagtcctcagcttaggcagttcgcctaggcatcgctccttcacttgcgggcatctaggagcaaagcggcagccggctggaagctgatctggcgcagggacattcccttttatcgcagttaacggctgtatatctccgtcaatgacaggaatcgattcaagcagcccttctgtgtaaggatgaagcggctgatcaaataattcttcgacggtcccattttcaacaacctgtccgcagtacatgacaatgactcgatctgccacttcagacacgacacctagatcatgcgtaatgaggagaatcgatgtaccaaatgtcgtgcataaatctttcatcaatgtgagcacctgtgcttgaatcgtaacatctagggcagttgtcggttcgtctgcaatgagaagtttcgggtcacagcttagcgcaatggcaatcatcactctttgccgcatgccgcctgataaacggtgcggataatctttgatgatttgttccggtctggaaaaaccaacaagcttcagcaggtcaatcgcttttttcgtcgcttctttttttgaaagttttttgtgatagatgaggatttctgttatttgttccccgatagttaggacgggattaagtgaggtcatgggctcctgaaagatcatcgatacgtcattaccacgaatgctgcataattccttttcaccatatgtaacgagatccttaccatttagcttgatggaaccgtccataatttttccaccagtgccgttaatcaagcccataatggataaggacgtaatgcttttaccagatccagactcaccgactaatgcaacagtttctcctttgttgatgctgaaatcaacgccatctacagcaggtatcgcttctttttttcgaaaaaaataggtttttaagttctgcacttcaagcagtgtggtcatttattcgcccctttcaccatcaattaatagaaatggatctaaaattcagccttttttgaataaaaagaattatcaaaatttatatttgtatattattacattgttatgacgaaatcaagaaaaatttagtaaatttgtaatatgtctctttttatgtgaatcattcactttgtgagtctatcgcctttaaaaaagtttcggacggctctgcaatcatagactcctcgctgattctgtgttcactgaaatattttttcacgatataaaatccagtggcataaccaagcattttggggtagttcccttttccataaaggaggttctgtatcagtctttcgtcgtcctgcactttttgatcaagatgactggatacccatttctggtacatacgctgaagctgcgtttcgtcatagagagtggtccatttggctgtatagctttctccgtatctatgatacacagcatattcagcgagcccctccatcatgattgtatcaaggaatgtaaaatctttttcttctttcgtgagaaaatgcaacctgcatacatggtgatattcatgagtcagcaatgttccgatacgttctttcggggtatttggcgacaaaaagagaaagaccttgtcgtcaaatgccatgccggattgataataaaattgctctctaatttctttgctgctctcattgactggcaaaataaagactggaatgtcagggcctttccactgcttttggagcgcccggtattctttcatgacgagctggaagtaccctttttctttgagcttgtcgatcatgtctatgcatgatctaaaagaccgaatcatgccgtgatgctgcaggtgggagagaatagaggaccattctttttcctccgcccctttaaaataaggaacaaagcgcgacgcaagctcctgaaatgatgaagattgatgaatgagatattgtgtattgactagacccatactgctaaacacctccattttcatcatatgcaaaaaagcggcgatctgtttatagatcgccgcctcttaggaaatattatgcttcgtattttttaaagataattgtcgcattatgtccgccaaagccaagtgagttacttagagccacttgtacttcttttgaacgtgcttcatttgccacataatcaagatcacattcttcatccggtgtttcaaggttaatggttggaggaatgacgctgtctttaattgcaagtacagagaaaatagcttctactccgcctgctgcgccaagtaagtgacctgtcatcgattttgtcgaactgatcgcaagctgattcgcatgctctccgaacacttctttaatcgccattgtttcaaacttatcattgtacggtgtgcttgttccgtgggcattgatataatcaatttcttccacagacaaaccagcatctcgaatcgcttctttcattgcgcggacgccgccttctccgtttggagccggtgctgtaatatgatacgcatctccagttgatccatatccaacgatttctgcataaatcgtcgcgccacgttttaatgcatgctcaagttcttcaagaacgacaatccctgcaccctcacccataacaaatccgtcacggtttttatcaaatggacggcttgctgtctctggatcaggatttgtcgaaagcgctttgttcgcacagaaaccagcaaacgacatttttgttaacggcgcttctgttccgcctgtgatcatcgcatctgcatctccgcgctgaatgactttaaatgcatcaccaattgagtttgtacctgttgcacatgctgttacagtacaagagttaactccttttgcgccaagtgcaattgaaatttggcctgttgccatatctggaatcatcattggaacgaagaacgggcttacgcgtcttgcccctttatttgaatacacttcaaactgctcttcaaatgtttcaagtccgccaataccagatccaacccatacaccaacacgcggtgcgatttcatctgtgatttcaagacgtgaatcttctaaagccttttgagcagcaacaactgcatattgcgtgaagcgtgccatttttcgtgcttcttttttctccatgtaatcttcaatgttaaaatcttttaattctgcagccacttttgctgtatattcacttgagtcgacacgtgtgattggtccaactcctgatacacctgctaaagcatttttccatgttgattctacatcgttgccaagaggtgtcaaagcacccaaccctgtaacaactactcgttttttatccattaatttgtgcacctcactcttttatcggccccatcgcatagcgattgcgccccacgttaatccgccaccaaaacctaccattacaatcacatcgccgtcatgaatttttccggcttcgatttcttcacatagtgaaattggaatagatgctgctgatgtgtttccatatttatggactgtcttcgacattttttcaactggcagctctaggcgttcgcgggctgcttccataatgcgaatatttgcttgatgcggaatcaagaagtcaacgtcttcttttgatagtccagctttttcgatgacgtttacgcttgactcgcccatttgtcttacagcaaatttaaatacttctcgtccattcatgattgtatgatctttttcatctaagtacaagtgcttaccgcctcttccgtcggctccaagctcaaatgagagaattcctttcccttcgctgacctctcctaacacagcagcacctgctccatctccaaacagaacagcagtattgcggtcatcccagtcggtaatacgagaaagtttttcaacgccaacgacgagcacgtgcttgaacgtacctgattcgataaattgttttccagtaacaagcccatacataaagccagcacacgcagcgctaatatccattgcacatgctttatgtgcaccgagctgctcttgaatcatacaagcgactgtcggaaatgcttgatctggcgtgactgttgccacaagaatcatatcgatatcttctgcagctacatctgcgtcagctaatgctttttttgcagcagcaagcgccatatgtgatgtattgacatcatcagaagcaattcttctttcttctatacctgttctagtacgaatccattcgtcagaagtttcaaccattttttctaaatcaagatttgttaacactttttcaggtatgtagcggccaaggccaataattccagcattcattgaataagactccttttactcatacgagcatgtgatattgtgatcttatattagtatctggtactaattttaccttatttttttctccttggcaatacaaacgtctaacctttcctctcacttttttcatagattattgatatatcgatagtagaaaggagcatttgatatggcacaaaaagatattttttcggcgatgatgtttggacagccgcttgaaaaggagaaaggcaagacagaagcaaaggaggaacgagcagaaacaacttcaagtgaagactccattgactacatgcatgtcatgaatcaaattgggaacattatgaactccatcgatgaattgaagcctgtgtttaaagatgttgggcctatgattagtgccttcaaaaaaaaattatcataaaaaaaagccactattctgtggcttttcctgattctgcatctgcttttccaagctcatatgcctcttgcatgacagatgtaaacaatgataaaagcggctgaagagcttcgggctcaagctgaatacctgctttatctaattcttcttttgcctgaggaaaatacttcatggcaatttgtaaaaactccatcgatttttcttgctgcatcgtcgtatcctcacttttcatttggcagtttgccagtttttttgtaagtcgcaatatcactttcaatgtctttcaaaaaagcacggtcaatggtagaactaaatttccccatttcgatcactccttctttaaagtcaaaggagtactcaccttgtgcatttagcttgccttcattaaatttcttcgcaataataccgtacgctttatccacatgctggactgtgcttgttaaaacggtatggctgccgaggttggattgatcggtgacatatccgatcgctgataaattatcggctttgatttgttcaatgacagggatattataaccatcacctgctggatatacaacatctacgccttgttttttcaatttttgatagagctccacggctttgtccgcatcatcccagttttcgacaaactcagcaagcacttgtacatgttcatcttgatattttgcacctttgataaagccgtctacttcgctttgccaatcatatgtagcaagaataccaatcttttttgattttgacatatgtgctgctgtcatgcctccgaaaaagcccatcgcttcacctttaaacgtcacattcgcaacattatccgcctgaggcttgtttccatttaccgtgataaattgtgttttcggataatcttcactgattaaattgaaaatttcgctgtattcattgccatggccaataatcaaattgactccttttttgtgaaattcttcaatggcatcaacgattttctctttgtcgaccattccttccttataataaacatctacaccaaatgttgattgaatatttaataagcctttataacctttcgttccccaaacttgatcattaatagtatcggggacgagtaaacccaccttctcaatctgtccttttaaaggtgcctgtgagcaggcagataataggagaaggaacgaaaagatcatgacaagccgctgatacttcatgccatgttcaactccctttgccacatgcaggcatgaacctgtatgttaaatataggtttattttatactgaaaaaagataagatggaagatcattcttgctttttgtcgaaaaatgttgagttttgtcttttccattctgctatcatttcttctgcttgtttgtcatctatttgtctttctaccttcaattcatgtgtcatttcctgtctttgttcagagcccgatgcccacttgaacaaatccctagctacatcttctacaaaaaatgcttcttcacgcttcgttctttcttcatcaagtgtccatggtccaaacatgcgcggtagaataactgccggcacattctggttggatgatttgtcttcggttttttcgtaaagaacacggtacatgccatgcgccgctttcaagtcttcctgtcttttatctgattcatctgattgaataaagatcagatcatacgtgtcttttccatcctgaaggtcaatgacacggaaaagatcatttctgccaagccacatcattcgttcttctaataacatcttttgctcttctgtttgatcatgaggacatgtgatgtccacttgaatgccctctttcatcatatattcacacagcgctaggccaaaaaattcatctgcccctatgatcagtcctgtctccatgttcatgtccccttttttagcttatcgaataaaaagaagagccctttccatgaagggctgttatcatcctattcatcacaattctttttcatgcgatttataaaacttgtgaatggattgaaagattcttctcggatgatcaaacatatgcaaggtgagatcgatctgacaatgctctggattcttcatgtgctgatcaataaaaggctttgcatgcagttcatatgcatagggtgcaccgtttagtctttgccatatgtgaattggtacatgagcagaatgaacagggcaagccgggagctgatacgtttccgcttccttttcagaacagccgtagctcttcgctaattctttgattagctgtttataaaagaatttgtgttccttttctctttctcgttgtgcatggagatgcagacatggattcaccagtgcaatggatcttagcacttctggcatctcttctgcaagactcatagcaacgagtgcgcccatcccctctgccagcacatgaatttctcggtttaatatttcttgttttaatgtgtgatgaacgagctgctttgcactaaaaacagcatcttcgcatccccagtgattcccatgaagatgactattaaacaatgtatatccttcatcctttaaggcagttaaaagctggtttcttccatagtgctgaagccagaatgatgtattttcctgcacaaagtgatttcggtcaccgaggataagaatgccaaagccatttggtttttgaggaaggtgaatgacgttccactgggaaccaagctggaaaaaccgttcgcttacacccatatggccagcctcctttcagtgattctgctttctatgatatgaacaacaactcttgtaggaataaggaaatcccctaatgacagaagaattctttttatttttatagcagaaggtctaaaaatggtcacataaaggctaaaacagtcttttcccctcactcgtatctatggtatgataatcaatagattgttacataaaggacggtgggattatgcattatattatcaccctcatttggacttttctgctgacacatatggctggttacatcgttgcttcgatgaatggcgctgcttatgactttactttgacttctattcttgcagtggtgtttacggttattttattcatctttgctgaagtaagtccaatgaaagaaacggaaagttcaacaaaacactcttaatacgtaagagatgaatgtgagaaagagctaaaatgatcttgtttttagctctttttctttttatgaaaagaggtacgctaaaaccccctgcagccacagggggtttttttattgcctacacctcgacggtttcggacttctgtttgtctgctgtcaaatggcttttcgcaagccctgtaaacaggaagattgcgatacctgataaaatttcaaggaccccaccaccagcaatgacaggtcccgctccaaatctttctgccaggacgcctgatacgacagctgcaagcgggaggaaaacatttgatgaagcattgatcactgcgtatacttgcggctgatcatcttggtcgacagacgtttgaataatgaccatttcaggtacattgatcgcactaacggcggcaccgaatataaaggaagcaagtaaaacgaccggcagccatgtactcatccctgtgataaagaatgcagccccttcaatcataccagcgacaataaagaacaaaccaaatctcttaattttcactttcgctagagcaaagcccatcataaaggcacctactgcagcaactcctcttaaaatggaatacaccatggaatcgctttgcaatgcttctgctacatatacagcagaaagtgcctgccacggagctgcggcgacattcattaaaatacaatacaacgtcagcgcaaataaaatatgatgatttttaacgacgagaaaccctctttttaagttatacaaatatgtattctttgcttgtttaatgcctgctgctttgtcttcatcggttttctttaatttaacgccgataataaacaggccggatatgataaataaggcagtggtgataagcagggtatctgcaggtccgattaatttgactaagagaccagccaccatgactgctgcaagtgcaacaatttcaaaagaagattgcaggatggcgtttgctttttgaatcagatgcttcggtacaatctgaggtaaaatcgccacagaagctgggttatacgctgcaccagttgccgattgaataaccattaatgagatcaataaccataaaggcaatagatgcgaaaaatgcagtagcggaataatgagtacaatggttgctcgaacgacgtctgaagcgaacatccatttagacaaatggtgctttttcataagaggtcctagtattggggctagcaaagatgaaggaagtacggttactgctaggagaagtcctgtaccgagcgctccatcccctctcaaaatcaatagccaaaggacggatgtaaaagcaaaactttctcctgtgtttttaatgagtcttgatatgaataatgaggtgaagcgtttattccaaacactttcactgagattcgtcttttccatcacacaaatcctttcaacaatatattacaattacatattttaccttatcttctcttttattcatactatttatttgaaaatttgaacttaattgttttttattataaagaaaaaagaggcatgacacatgcctctaaagacttattccaaccgactcttagtcaattgcttacggctttctctgataggtccaaacacggttatggtttgagttatccggaaagacgtcgcctgcttgaagcttaatctttaaaggatctttcaccatactgccggtttcaccgatctcgacatacacaccattatttggtgctttattccctgatttaaactgatgctgctgacccatttccatcctcctttctcgatgatgttattatgtcccgtgacttgcctctccaatcctttatgcaaaaagtccctgctcctacgagtcagggatgcttttcatttatttggtttgttgatacatgagctctttgattaatgctttttgtacatgcaggcggttttctgcctgctgaaatacttttgagtgcggtccgtcaataatgtctgctgtcacttcttctccgcggtgtgctgggagacaatgaaggaaaatataatcttttgctgcatgacgcattagttcatcattgacttgatattctttaaattcagcaaggcgtttctctgtttctgcttcctgtcccatgcttgtaaacacatcagaataaatgacatctgcattttggacagcagcgacaggatctgtcgtaacgatgacttctgcgcctgattgttttgcaaactcacgtgctgtgtctgttacttcttgaagtggttcatagcctttcggagatgcaactgcaatatcacagcctagctgcgcacagccaaccatcaaggagtgcgccacattatttccgtcaccgatgtaggcgactttgattccttttaatgttccttttgcttcttttattgtcaataaatcagcaagtgcctggcatggatgggagtagtcagtcagcccattgatgacaggaatggacgcatattgtgccagctcctcgactttctcatgttcaaaggttcgaatcataatgccgtctacatagccagacagcacctgcgctgtatcactgatcgtttctcctctgccgatttgcaaatcatttgagctgaggaagagcgcatgtcccccaagctgcgtcattcccgcttcaaatgatacacgggttctagttgacgatttttcaaaaatcatcgctaatgttttccctttgaataaatcttggtatgggttttgtttcatttcttccgctttttcaattaaataagcaatgtcattgattgagaaatcttttaatgataaaaagtcttttccgtataatgtcggttgcaggtcaacttgactcatgccgtcacttcctttttgtataattcttggagcgatactggtgatacatctccatttttcccttgcaggaatgcttgaacggtttcatattcggttagaacttggacgccatgtgtgagtgcttttacgcgttgctcttttgcctcttcatcttcgcctaaatggatatgaagggatttatcttcgttttgcagccaagtgtcaaagctgtccgtccagacatcaaaacctgcatgttttgcttcatctaccaattgttcactgccttttataaataagctgcctttctgatgccagattgacgcaaacacttttttcaaggcgctttccgcgttcttacctacacacattccttctcctgtcgctttcatttcaggtgtcagctttaagtcaatatcttgaatggcatgtgatgagaaaactgggaatttgaccgctgtgccccctttgtttttcgttactgggttcagttcttgaagcgttgcacccgctaataattgagtcgcaagcggaatcatgtcaatgcccattaccttgctgacaactggaacggtccggcttgccctcgggttcacttctagtacaagcgcctgatcccctttgatcacaaattggatattcataatgcccttaaacgctaatttattcgctatttgctcggacgcagtatgcacctgctgtttgatgtcttcactgattgagacacttggtaggatggcaaagctgtcacctgaatggacgcccgctttctcaatatgctcgacgatcgttggaatgaaggtcgtttttccgtcagaaatcagatccacttcaacttcttttccagtgacatactcatcaattaaaattgggtatggcaaatgatctggctgatcaagtagtgacgtcaaatgcgcttctgactggacaaccatcattcccattccgccaatgacatacgatgggcgaattaacacagggtaaccgatgcttttagcatgcgtgagtgcttcttctttagaatgagctgtatctccttttgcatgaggaaggttcagttcatcaagaagctgatagaacagatcacgatcttccagcgcatctagcgtgtcaaaagatgtacctaacaacgtaatgcccgctttttctaagccttctgctacattgatggcagtctgtccgccaaattgaacgatcacaaaatcaatttgctctgcttccacaacgtttaagatgtgctctaatgtaatgggctcaaaatataaacgatctgcaatttcataatccgtactgaccgtctcgggattgttgttcatcatgatggtttcaaagccaagcttttgcagggtaagaacgccatgcaccgcactataatcaaactcgactccttgcccaattcgaattggaccagagccaatgataagtgcacgctgttttgttttctcttgatgctctccatcacttttaccaaagtatgtggaatagaaatagttcgtttttgcatcaaattccgctgcacatgtgtcgacaattttaaatgaagccgtaatgccatattcttgacgaagctgtctaatagcttcttcactattgcctgttagaagagcaatcgtttcatcaaggaaccccttttcctttacctttttcaaggtgtctttagagagcgttccatcatggttcttcaattcctgttcgagcgtgatcatattgttgaacacatgtaagaagaatagatcgattttcgtcgcttgatggatcgcttcaaccgtttcctttcttgaaagaagctccataacagcgaagaaacgtcgatcgtctggtgttttgacaagctcaaatagttgttcagtcgattgacctttcaattctggcaggtggaagccctttgttttaatttcaagggaggcaacggctttttggatggctgactctaaattacggtcaatcgccatgacttcgcccgtcgctttcatttttgtacctaattgacgatctgcctgtttaaatttatcaaacggccagcgcgggaatttcacgacgacataatcgagtgccggctcaaaactagcataagttgtgcctgtaagcgggtttttgagttcgtctagtgtatagcctaccgcaagctttgctgccattttagcaatcggatagcccgttgcttttgaggcaagagcggatgaacggctaacccgcggattcacctctatgacaaagtattctttactaagcggatcaagggcgaattggatattacatccaccgactacatcgagtgctgaaatgattttcaggctcgctgaacgaagcatttggtaatcccgatccgttaatgtttgcgaaggtgcaacgacaattgagtctcctgtatgcacaccaactggatcgatattttccatattacaaaccgtgatacacgtattttgacggtctctcatgacctcatattccacttctttaaagcccgcgatgcttttttcaactaaacactgatgaatcgggctcgctaaaagggctccttcaataagtggtttaaacgcttcttctgttaaagcgattccgccgcccttaccgccaagtgtgtatgctggtcttagaatgactgggaagcctacttcttttgcaaattgaagggcatcctttgcattatccacaatttcactatctggtacaggttcgttcaactgcttcatgagagcacggaatttctctcgatcttcaccgttttcaattgtttcaactgacgttccgagcagggttactccgtgctttttcagcacaccggctttttctagctcgacagcaaggtttaaagcggtctgtccgccaaggttggctaaaagaccatctggtttttccttttcgatgattcttgtcactgaatcaactgaaagcggttcaaaatagatttcatcagcaaatgattcgtctgtcataatggttgctgggttgttattcactaaaatcactttgtagccctcttcttttagggccatacatccttgtgttcctgagtaatcaaattctgctgcctgaccaatgatgattggaccagacccgatgactagaatggtttgtatgctttgatctttaggcatgtgcgacttctctccttgcttgtttcactttctcaataaaatcatcgaatacccattcactttcagcaggccctgggtgtgcttctggatgaaattgaactgacataatgagcttctctttatgaatgaatccttcaacagatccatcattaacatgaaggaatttcacgtccacttctttgtcattcatgcttttttcattcaccacatagctgtgattctgacttgtcatgaacacacgtttggattctgtatcttgtacaggatgattcgccccgcggtggccaaatggaagtttatacgtatccccgccaagtgcaagagcgattaattgatgacctaagcagatcccaagtgtcgggaaggtcatcatgatctcatgaatggtttttaaatatggcttcaatgttttgggatctccaggtccatttgatagcaggaccgcatctggcttcatttcaaacaccttttccagctgtttgtacggaatgacggttactttacagccgcgcgcttcaagcgaatctgctattgattttttaaagccaaaatcaataagcgctacatgttcctcgccgctgccttgagtgtagatatcatcgtctgtcacctgtgcaaccacattgtcttttttcatggccggcggtgtttcattttcgtctacactgatcacagcgttcatcgtcccatttgcccgaatgttttgcacgactgcacgtgtatctgtatgtgtcagaagcgggatgttccacttctgtaaataatcttttaagctaaccgcagcaagatggtgagagaaatgatcggctgcttcatacacaacgaccgctttcacttgtggttttttgctctcaaagtcttcatgattaatgccgtaatttccgatgagtggatatgtgaaaacaatgatttgtcccttataggaaggatctgtgagtacctcttggtaacctgtcatccctgtaaagaaaaccacttcacctgtcttgccagcttctcctgtcagatctccttcaaaagaggctccatcttctaaatttaaataacctttcatgcttgtgtcaccccaaattgaataattagtaatataaatgcatttttatgcgttttggtgtaaaaaaatttataccgtcactgtttcatttgctaaaacatgagtaatcgcttttattgcttgatctatttctgctgtttctacattcagcggaggcaataaccgaatcacattcggaccagctggaagtactagcaatccttgttctctcaaagctgtgatataatcccccactggctgatgacattcaatccctgtcatcaatccttttccgcgtacttcttttacgatattcagttgtttcagatcttgcagcttttctaacagataagcgcctttttctttcacttctgtcagaaactcatctttgaaaatgacatcgagtgttgcattcactgctgccatggcaagcatgttgccaccgaaggttgttccgtgtgaacctggtgagaatgcgtctcctaaagcctttttcccgatgattgcaccgactgggaagccattccctaatccttttgcagaagagataatatcaggatcaagtcccgtttgttcgtatgcaaatgctgttcctgtacgtcctatacccgtttgaatctcatctacgatcagaagtgcttcatgcttttggcaaaacgcttgaacagcttctagaaattctgttgtcgctggatttacgccaccttctccttgcacaacctcgagcatcaccgctgccacattatcgacttcacatgcggcaatcgcttctggatcattaaacggtacataatgaaagccttccagcatggggccaaaacccgttttgattttatcttgacctgtagcagccataccagcatacgtacgcccatgaaaagagtgcaaaaatgtcacgatgtttgttttccctgttgctttacgcgctaatttgatcgcaccttcatttgcctcagctccgctattacagaaaaacacgagatcccctgaactgtttgcagctagtttttctgctgctttttcttgtagtccattttcaaatagattcgatacatgccagacgtgatcaagctgtttcttgatggcttgattgacctttgggtgattgtgaccgagatttgtgactgctatgccttgtataaagtctaaatattttttcccatttgtatcgactgcccaagaacctgctgcctctttaatttcaatattccaccgtccatatgtttgaaagagatgactcacaggaccgcctccttttccttcacaattcttgttcctttaaaggtttcccctgtaaagatactgcctttgccattgacgatcatgacttcatccacatctcctgatagagcattcaaagcggattgtacttttggaatcattcccccggaaataatgccttcatcaatgagcgtgagagcttcttgttcggtgacaacatctaataattcaccattttttaaaatgccttcgacatctgtcacaaacatgagcttatcagctttcatcgctcctgcgacagcggatgctgctaaatcagcgtttacgtttaacgtttggcattcttctgtcatagacagtggtgcaatcacaggaataaattgtttctccattaatgcttctgccatttctggatggacttctttgatttcaccaacgtacccgtacacgtcttgatcaagaaaatcagcgacaagcatccgtccatctttgccagacacgccaacagatgagatatcatgctttgcgagctctgatacaaagtatttattgaccgttcctgaaaggaccatttcggctacctctaatactggcttcgttgttttgcgctgcccgtcaacaaattctgttttcacttctaatttttgaagcatgttcgtgatttcagggcctccgccatggacgatagccagcttaaacccagcagcttgaagtgagcggacattttcgtaaaaggtatctgaaagttctcgaatgacactgccgccacacttgaatacgatcgttttatccatgtctatctccttcattatgtgcgatagctcgcgttaattttcacataatcataagtaaggtcacagccccatgccgctgcttcaccatttccctcattcatttgaattaaaatcgtgatctcatcctgctctagatacgcttttgcttcctcttcagagaatggctgcggttcattatgtttaaacagacattgcccgcctaaatacacttctacctcttgtggtgtgactgacgctgcgctatggccaatcgctccgatgatacgcccccagttggcgtcggtgccatatacggctgttttcactagacttgaaccgacgattttcttcgctatgatgccggcttctaaatgatttttagcaccagtgacttgcgcttcaattaatttcgttgcaccttctccgtctctagcaatatctttggcaagatcctcacaagctagctttaatccttccttgaacaatggccattctggatgctcttcatttagaatttcattttctgccatgccatttgccattacgagtaccatatcgtttgtcgatgtttctccgtcgacggtaatttgattaaaggttacatctgtaatatcacgaagtgcgttttgcagagcttcttgttcgacatttgcatctgttgtcacgaagccaagcattgttgccatgttcggatgaatcataccagagcctttcgctgcacctgaaatgagaatctctttgccgtttatcgtcagggtgtatgttgtgtttttaatgactgtatctgttgttaagatggcctcttcaaaatgaccatttcctgcttttgcttctttcagctgagtgatgccttttttgattttatccatatccagatactctccaatgacaccagtagaagaaacagcaatgtaatcaggttctatccctaacatatctgcgcaggctgcctgcatttcgtatgcgtctttcaaaccttgctcaccggtacatgcattggcgatggcactattgacaatgacaccttttaattgccctgtcttttttaagcttttctgagtgacttgtagaggcgcagcttgaaagtggctttgtgtgtataccgctgcactcactgccggcacttcactgacgatcagtccaaggtctttttttgaataacgtaatccaatatgaatcccctttgcttcaaagccttttggtgatgatacgtcaccgtctattttaacaatgcttttttcattcaattcgatcatgtttgttgtctcccttgttcttatggatagagaggtgtcattgtgaggcccgcctcttcatctaagcctttgatgatgttgaagttttgaaccgcttgaccagctgcgcccttcatgagattgtcgatcacagacacaattgtgagtctgcctgtacgttcatctaaatgaaagccaatgtcacagaaattactgccgtatacttcccttgtttgcggatatacttcgtgatctctcactctgacaaaataggaatcttcataaaagcctttcatatgcttcatcaattcctcttttgtgatatctgatttcagctgagtatacatcgtcgccataatcccccttgtcatcgggacaaggtgcgttgaaaatgtgatgttcgccgtttgcggattccaatctcttaatatttgctctatttcaggtgtatgttgatgttcatttaccttataaattttgaagttgtcgtttagctctgaaaaatgcgttccaagtgaggcagatcgtcctgcaccggacactcctgtttttgcatctatgatgatcatagattcatcgattagattctgtttcatcagcggtgctaaaccgagaagaactgcggtagggaagcaccctgggtttgcaatgacttcagcctgctcaatcgtttcacgattcaattccgataacccatacacagcttgttgaacagatacttgatcagctgcccttcgtttataccaagcttcataggttgcaccgtcttgaatacgcaaatcacctgataaatcaatgataggcactccttggttcatgagcttcggtgtgagttcacttgatacgcctgctggtgtcgctaaaaacacagcatctgtttctcgcacaatggcagcaggatcaatggcttttaatgtttgatcagtaatcgttgttagatgcggataagattgactgtataattgcccatcaccactcgatgaatacaatatacattcatcgacatgtggatgctgcttgaagatacgaactaattccgcaccaccgtatcccgtagcacctataatacctattttcaacgtcaatacaccctcttgatctttgtgaaattatttaacattataacatgtataaaaattaattcaattgtatatttaatatttcttttcattttttttcataaaaaaatccacatatcttcataagacatgcggatttatctttcatatttcatcatgatgactatgagagcactgcataaatataatatggagcttgcataaaaaatgaaataaacggtgaagaaatctgcaaacaggccgccaagcataatggctatcgatgaaaaaagagctgtccaaaaatgatagcggccgacctctttcattcttttgttctctgttgtcagttccgtgacaagcagtttttccccgtgcttttgaaagccgccaagcgcaccaagtgcaagctgaatcatatacacctgttccacttctgttatatgcggaaatagcagtaaaagaaatgccataccgaacgaatgaataattaaaaagagccgcctgtcagtagtttcgggcagttttcctaagagtaaatgaataaacgctccgcttaaaccaaacaagccataggcaagaccaaactgtgaatagcttgaaccaacatttttaataaaaagaatgtaaaaagggaaaatcaaactgctggcgaaaaacagcaggctttgtgagtagacgaaccatttcattgcttttgcattcattgtgtattgtacctttcataaaagtaattgataaatctgccatctggatctgcttgctgtttcttttggaagaatacatcggttttaggataggcccgcttcatttgcgctttcgtttgataaggcatgtacggtaagtaatagcttccatggtgccgaagcgtgatatctgtcatttgccggatgatccgctctgcttctgccttcttttctttctcaaaaccataattcactaaaagaacaagggcaaacatatcttctttcgcatatgagagatccgctttttcatttttttgtacgtatcgtatcgtaatgttcattaaattcaattcttcctgttgtaaatagcttctcatgtcatcaatgtacgcacgaaagcggtccactgggacgaaatattcctgaagcacatctgtatctgactcattttcatattctaaaaaagcagaatctgagcgcatcacattgtttcttgtgatcaactgatcattttgactttggaaatacttcttttgtaaatgccagagcagatctttccccatatcaaatcttcttgaaaggccgagcataaatttgagtggcatgacgagttgatcctctttcagctcttgatatgattcgatctcttgttgtgaagtgagggaataattcgttacatacatctctttcaaaaagtttgttttcgttgttgagattctggcaagatgcatgcgtacttctttattttgtttgacatgtttttgaaaataattgctgtattcgcgataatcaagagaggttgtctccattttgtataactcatctttcgttaacgaaagctcaacatctaaaatgacgccgaacaaaccatatccgccaatcacggcagtaaacaaatcattgcccggcttcactgtaacgatgtccccatctgcctgaagcagcctgaaggaacgaactgtgtctatgagtgagccgtagcgaatgtcacgtccatgtgcgtttgcactgagagaaccgccaatcgtgaagatattctgtgattgcatgaccttcacggcaaggccatatgggttcacatatgtttgtatatcatcccatgtaacgccgctttggaccctaatcgttttctttttttcatcaaatgctaaaatctgacggaatttggtcatatcgagcacgatgccattttcataatacgtgtggccacccatgctatgctgtttccctgcaattgatatcggcaggctttttgctttcgcttcttttaatacttcttttaaagtatctatttcttttccttgaacgattttttttattttgacaggcatgagatgactgacatctgtaaaggcttctagatcttggcttttgtgtgcttgctcctcacgaatggtgattgacgcaaaaaatgcagctgcgtatcccatgaaaagaacaatccataaccattttcgtttcattataggtactccgttctatgaaattacacccattatatcgtactattctcttcctccaccttattttttcataaaaaatgcctggcatgagttcaactcataccaggcatttttatttgtgcttattgaataccgagcgcaatttttgcgtatcttgacattttgtctcgtgtccaaggcggattccatacgatgtgaacttctgtttctttcacttctggaagatcacttaatgcttttttcacttcatccacgataactggtgcaaggggacaccccattgatgttaaggtcatcgtgatatccgcttttccattctcatcaagatcgacatcatagacaagtccaaggttgacgatgtcgacattcagttcagggtcaatcacctgttctagggcgcctaaaatattttctttcaatgcttcatccatgatatccactccttttccattagtataacgtactttttcttttgactaaacgtttgtgcttttcagatgtgtcacaaaccactcaatcgtttcaaacattgcttgtcttgagaccttatggccagcctgtccatctgtgataaaacgaatcaggtgcggatcttctttatattgggttgctgccaactcgtcataaagagcttttgcatgtctgtaagggacaactggatcgttttccgcatgccagaataacagcggtcttttgtttaatcgatctgtttgcagcgttaaatcataaggacgcagcgcgtctaattgctgatgaacctcttcgtctgtaatctctttcatcaaccctttgtgccgcatgtccataatttgtgcttgtaggaatgtcgtatatttcggactgcccatcaagctgactgccgctttaatccaatcatgttttgcgagtgcaccaaaggtcgtgatgccgcccatggaagtacctgcaacaccgatcagatcggcttcaatcaaatgtttttcttgaaagtatgttttgagtatatcgatttcacgtatttcgttcaggacaatttcccagaaccttgacgccagttcctctaagctgaggttttctgatcttacaccatgataagcacagtcaggcaaaatgactctcatgcctttttccgccaaatgaaaggcgaagtgtaaattgtgctcgcgtgcacttgtaaatccgtgtataaaaaatacaagcggcagcggtttgtctttattttcagcttttacgatatgtaaaaatggaatatcgcgcgtaatttgctcatcaatggtgatcacagcctatgaatcctcctttatcattcccgtctttgtttattttaacatgtagacaacaaagatgtgataaagatacactataggtagaggcgccgcacgaactgcctcctatcacttacagatcaaaggagattttatggagactaaaccttatctaatcgcacttgacctggatggcacgttattaaaagatgataaaaccatctctgcgcatacacttgacgtcattcaaaaagtgaaagacagcgggcatcatgtctgtatttcaaccggccggccatttcgttccagctctccttattatcagcaattacagcttgattcacccattgtgaattttaatggagcgtttgtccatcatcctcttgatgaaaaatggggcagatttcatacgtcacttgatcttcaagtcgttaaacagcttgtagacattagtgaggagtataaagtacacaatgtgctagctgaagtgttagacgatttgtatttccattatcatgatgagaaactcattgatatatttaatatgaatgcaaataaagtgactgttggagaccttcgggacaaccttggagagaatgtgacgagcgtgttaattcacgcaaaagaagaggacgttggagctattcgaagctatttatcagatgttcatgcagaagtgattgatcataggcgatgggctgccccgtggcacgtgattgagatcattaaaacaggcatgaacaaggccgttggactgcaaaagatcagtgattattacggcgttccacaggagcggattgtggcattcggagatgaagacaatgatttagaaatgcttgaatttgccggatgcggtgtggcaatggacaacgggattgatgccgtgaaacgtgtctcaaatgaagtcactgatacgaatgaacaagatgggattgcaaagtttctaacgaattacttctcgctttaatttttccattcatacatagcagatggaagcgggcatactaccgttagacaggttgtcctgtcagcttgtgtaaaggggcggattccgaatgggtaaaagaagcaaatcgaaacgctttatacaacaaggtaaagattcagtcagtctgcatgatgcacgttttccttatcgttctacacttgaagaagtgtcagacaaagaaaatatgaagactgatgcttctggaggttcattgtgagaaacgaactttttgatcaagccaaatcatttactgaagaagcccttacttcttcattttcatctgggttagagcgtcaacaggcggtcaaacgagccaaaaatgccgtatcttctgcatttgccaattcgacagatgcagaaagaaaccagctacacaccttccaagacttgctcgatgatctctaacataaaagaagctgtccattaaggacagctttttctgattctcatgaagctgaaagcacttatttcacttggaatgttttcttttccgtgatttgcttcagcccttctgcttttcctttaaatgtgacgaccgcttcatacgttcccggcttgacaccatttgaccacgtatcttgaaaatcataggcttcgcctttctttagcacaaatgattggatggcctgagtgaacatacggtcttttgaatagcggtattgttcatttccgttttcgtcatacacactgagctcgaatttttggcttgtgttaaaggtaaattcaatatctcgatctgattcatttttcagtgacatgttaaattgaaccgaagaacctttctggacggggtctactgtgagtacaaccgttttttctcccatttgaccggatacctccttgtctggttcatcctttttttgttgtccacaagcggttaaaatcaatacaacgagaagaagtaccaacccttttttcatacgctacccaccttttaatctcgtctgaaaaatccaagaatattagttgtttgcacaatatttgtaaaagcttttggatcgacttctttaataatttgttcaagttcatacagctcataccttgtaatgacgatcaccatcatttcttttggctcgttggtaaaagccccctttgcaggtaccgtcgtaatgcctctgaccatttttccataaatggcttccttgatttcatcagccttctttgtcacaatcatcgcggtcagcttctcatgtcttgtatggatggcatcaatgacccttgtggtcacatataatgtgacaagggtatataatgctttctcccaaccttgtaataatcctgctgtaaaaatgatgataccatttaaaatgaagaaatacgtaccgactggtttatccttccacttcgccaagatcatggctatgatgtcgagtccgcctgtcgatgccccaaatttgagcgtgatcccaatccctactgcggatatcacgccgccaaacacagcatttagtaaaatatcatgtgaaacactcgtttctggtaagatgccgaggaaaatggtcgtcagggcaacactgatgatgctgtaaaacgtaaaggaacggcccactttcatccagcctaaaatgccgactggaatatttaaaataaataatagaattcctgtggatacataaaatggggcatattgatccattaagctggataacagctgggctacccctgtaaacccgctcgcgtatacatcagctgggattaagaataaattcagtccaatcgcattgagcagtgcaccaatgacgacgacaatgagtttttttgcttctccgatgaacatattgtcattcctccacttaccattctctctatggttttccctaaaatttagaatttgaacacgaaaaagtgatttctgtgatatagttaggctaaaaagttgcaaaatatggctgatttttttagaaagaagggattttgatgactgttcatatcatagcagacagtgctgctgatctgcctctttcttattatgatgaacataacatgacgcttattccgctccgtgtattgcttggcgaagaggaatttgaagatttgatcaccattgaaccaaaacaagtatttgatgcgatgagacaaggcgccagcccaaaaacgtcacaagcttcaccaaaccgaatcaaagaagcctttgtttctctcgcacaaaaccatacatctgcaatctatgttgccttttcatcagagctttccggtacataccaaacggctgtgatgatggcaaacgaagtgaaggaagaataccctgattttgatttacgaatcattgattctaaatgtgcttcactcggctatgggcttgctgtcaaacacgctcaatcacttgccattgacggaaatacaatacaagaaattgaaacgtctgtaaagcatttttgcgaatctttacaacatatttttactgtagacgatttatcgtatttagcaagaggcggaagaatcagtaaagcgtccgcatttgttggtggtttattgagtattaagcccattttacacgtcgaggacggaaagctcatcccccttgagaaaatccgcggacgtaaaaagctgttgaaacgcattattgaactgatgaaagaacgtggaacggattggtcaaatcaaactgttggcattagtcatggtgatgatcctgcacttgcagaagacatgagagaattgattgaagccgaatttcatccaaaggaaattgatattcagattgtcggcgcagctgttgggtcccattcaggaccaggcacgcttgccatcttctttacaggcaaaccatcataaaaagcacccttccctgacacatcacgggaagggtgcttttcttatgacttatgaaagtttaaaacggtggacggtttcatttagccttgccgtcatactcatgagttcttctacttgtttgttcatttgatggaatgattgcagctgttcattggcagaggcagaaatttcttcactgccagctgctgtttcttctacaaccgcactaatattttcaatcgagttgagcacttgtccgccaagctctgttgattgaacaatttggtcatttaagaccgccatttcttgtttaatgtgctgcgcttttgtttctatatcttcaaaggagtgtgaggttttgtccatcgcatcctgctgctgaagtgaaagcttgactccttctttgacagtttgactaatggattgaatgcctctttcaatatgactgaccatatcaaagatttgtcttgtagcgttagatgattcgtcggcaagcttacgaatttcatctgcgacaacggcaaagccttttccagcctcacctgctcttgccgcttcgatcgccgcatttagcgaaagtaagtttgtctgatccgcaatgtcagaaactgttttggccatagccgagatcccgctggcatattgcgtgaattctcctgccgactgttcgatttgtcttgtggcatgtgtgtttttttcaatcgccgttttggtttctgttaacgtgtgctttccactttctactgcttctatcgcgtccgctgtactttggatgactgtttgtgaacgttcggaatttttacgtccatgctgatccatcttttcaatcaagctgacgccatgctggagatcctctgaaatggcttgtgacccatttgccatctcgtctgtcgagacagatacttgatttgcagattccatcagctttttgttttcatcatctaactggatcgagaatgtctctacttgacttgagacattactgatttctttaatcaaactaatcagttgatctgtcatttgattaaaggattcattcaagccgccgatttcatccttacgctgaatgtccatccgctcgacagcaaggttgccttctgcgatctgcttcgctctgtaggaaagtgatttaattggtgtcacgatggatcttgttaatccaatatttaaaaagacagcaatgacgatcagtgtaagggctgcaacgagtgcacttgtgatgatccattgcacattatccgctgtattctctagattttgtttatacgcttcttccgctcttttattcattgtatgcacgtcgtttaagacgccatcaattcttgctgctacccgccttgcatctgatgcatttttttcaccaatggcgccattcgcttccttggtccacgtatcatattttgcatttaaccttgttagtgcatctttattgatattacctgcatttttgtttaacgtttgcagctgtttttttgctgtagaaatatcggtttgaacaacttctagctgttcatcagacagtgtcattgagtaattggtcatggcttgttcgacactttcaaagcttgcttttgttttttgaacgtttaataaggtttgaacttctgtttcatttgatgattggatctttgtcatactaacaatgataaaggcgatgacaccaactgctaaaagaagtgagacgagtgagttgagtaaaattttgatgcgcaagctcatgatgcgtccccctcttcttttagcaatttctgcttcagttcatttacttttttggtcaatgcttcagcattcttcagcacccgaattcttgccatgtcgattccgtcattgcttaagtcgtaaataacatgcccatttttgattttgttgctcttgacgagctgttcgctgaattgatagaccacttcgtcgactttttttaccatggacgaaatcaccgctttttcagcggtgtagtactgatcactatctacaccaatggcatacttgccctctgattgtgcttcttttaatacaccaacacctgtatagcctgctgcggcatataaaacatctgctttctttttgatcatgtctttggctattttactgcctttgcccgcatcactaaacgtattggcataggtggataagatcttaattttcggattcactgatttggcgcctttttggaaccccttttcaaaacgatgaatcacatccgcatcgacaccgccaacaaatccaatgacatcacttttcgttgtcatcgcagcaagtgcgcctgctaaatagctgccctgctcttctttaaacgtcacggaggttacgttttttagctcagatacagcatcaatgagcaagaactgcttcttcggatatttctttgcgactttttctaagtcttcttgcatactaaagcctaccccgatgacgaggtcattgccagcttttacgagctcggtcagccctttttcatatgtatcggtttctgcaatttctctataatcaaattcaattcctaggtcatcacgtgctttttctaatcctttaaatgacgaatcgttaaatgattgatcaccaagaccatcatctgtgagcataacgccaatatgcttcgcatttgatgctggtggtttcccttgttgattgctgcatgcagctaacaccataagcatggctaccaacagaagtaatgaaattttcactttcatccaaacacacactccttttatcatccttactcctttcttatcggatttgagaggcgttgtttcaatgattatgtgaaggttttccagattttttatgacttttttcactgaaaaaaaccattatttataacaaatataaaaaaagggataaaatcatcatgattttatccctttttcttcatttcagtgtaatgtgaaaacccatgaggttagagttctctttcacgctgctcattttttctcgtatgtccagccctctttttggtagactaggccgtttttcatcaaatgacctaatgctcgtttaaaggctgccttgctcatttggaatcgttcgcggatgtcttctggatcacttttgtctccataaggcatagcgccatttctcgttcgcatataggttaagatttcttctgcatcgacagataacgcttcctgttttctaggaagcagagacacgtttacggttccatcctctttcactgcaatgacgcgtcctgtcacggtcgatcctaatcttggttcttcctttcgttccgtacggtggataaaccctcgcacgcctgtatctgtcagcataaacgagcctgtcgcaattaagcggtaaatcgttccagtgatttctttgttcattaaggtttcaggtgcctcagtaaacaattcactgatcacatcttcagtggctggctttgcgaacattctgccgtagcttgtgactttcagcatacagtaaagtttgtctccttttttcggccatgcttcctcaaaaggcggtagatgttctgttgcaactagtgcatcctttgaaagcccgacatccacaaatgcacccatgtcttctacgacgtctacgacttctacccagccatatgtatgcgcattgattgaaggtattttcatcgtcgcagctagtctttcttcatgatctacgtataagtagacctctacttcatcctggtcaccaatatcttctgtcatttcactgcggtgcaaaaggaccgaatcttctccatctgtcaaaaagtaaccgtattccatctcgttctctatttgcaaggtcagttgctcacctggtctcatgttctcttccttcctatctgctcttaaaagagcgttcgttcatcttttgattcactttattctactatacttctcctcacatgaacatctctagttctgttagctaaagtggacaaaccgaacacgatttataccgctactggcagaactctttgactcgtctcttcgataaagtttcttcttctccacgttgcatgataaaatagacgcaatatctatacatggaggtcatgtgttatggcaaaagaaagctcatttgacattgtatcgaaggtggaactgccagaggtgcaaaacgccgttcaagcagcgctcaaggaaattaaaaaccgttatgactttaaaggaagtaaaagtgatatttctcttgaaaaagaagagctcgttctcatctctgatgatgacttcaagctggagcagctaaaagatgtccttgtgtcaaagctgatcaaacgaaacgttccaactaaaaacatcgattacggaaaaactgagcatgcccttggcggaacagtgcgccagcgcgcgaagctgatcagcggaattgatcaagacaacgctaaaaagatcaatgcactcattaagcaatctggcatcaaagtgaagtcacaatttcaagatgaccaagtgcgtgtaacagggaaaaataaagatgatttacaagaggttatctctcttatgcgcaaggcagatttaccgattgacgttcaatttataaattttcgataaatttcaaattttccattgattatttccgattttttcgatacagtggatggaagttcaattcattgacatgttcatatcgctttcttatcaagagaggcagagggactggccctgtgaagcctcagcaaccggtgtagtagaaaaatattttctatgaccaaggtgctaaatccagcaagcaactgcttggaagataagaagaagaataacgatacagccaaaaagtcttcttcttatcagaaggctttttttgttacatagaaataaggaggaaaccaatgggcctattacaagatttacaaaaccgcgtactgattgctgacggtgcaatgggaacacttttatactcttacggcattgaccgctgctttgaagaattaaatttatcgaaagaagatgaggtaaagcgcgtgcacgaagcatatgtgcaggctggtgcagacatcattcaaacaaatacgtacggcgcaaattatattaaactatcccgctacggcttagaggaagaaacaaagcgtatcaatacaaaggcggtacaaatcgcaaaatcagccgcaggctccgcttatgtccttggaacgatcggcggtattcgaacgtttaacaaaaatgcctacacgattgaagaaattaaacgaagctttagagagcagctatacattctattaaacgagcagcctgatggattattgctagaaacgtattatgacatggaagaagcgaaggccgttctccaaattgcacgtaaagaaacgactctcccaattgtcatgaacgtctccatgcatgaacaaggtgtgttgcaggatggaacaccgctcaaggatagtttatctgaattgtcttctcttggtgcagacgtcgttggcatcaactgccggctgggcccttatcatatgattcaggcactcgaaggcgttccaattttagaaaattcccatttatcagtctatcctaacagcagtcttccctctcttgaagaaggcagactcgtctatgatacagataacgattatttccgaaaaagtgcacttgaatttagaaatcaaggcgcacgtattatcggcggctgctgcggaacaacgcctcagcatattcaagcaatggctgaagcggtcaaggatttagcaccgatcactgaaaaagaagtgaaagttttaaaagaagaaatcatttcgattcaagatcagcggactgaaccaggtcttgatgagctcgctacgaaaaaacggacgattattgtagagcttgatccgccgaagaagctgaacttcgaaaaatttctcgtcgcggcaaatgagttaaagaatgcaggcattgatgccttgacattagctgataattctcttgcaaccccgcgcattagcaatgtggcttgcggggcattattgaaacagcagcttgatatgcgctcactcgtccatatcacatgccgtgatcgtaatttgattgggcttcagtcccatttgatgggtcttgacacccttggtttaactgatattttagccattacaggcgacccttctaagattggggatttcccaggtgcaacgtcggtttatgatttaacctcctttgatttgatccggctgattaagcagtttaacgaaggcctttctttctcagggaaaccgattggcaaaaagaccaatttttcagtagctggcgcgtttaatccgaatgttcgtcacattgataaagcggtcaaacgtcttgagaaaaaaatcgaatacggtgctgattattttatttcacagcctgtttattctgaggaacagcttgtgaaaattcatgaggagagccgtcatttagataaaccgatttatattggcattatgccgttaacaagcagtcgaaatgcggagtttattcatcatgaaattccaggtatcaaattatctgattccattcgtgacattatggcgagggctggtgaggataaagaaaagcagcgagcagaaggcttagcgattgcccgctctttattagatacagcctgtgaattgtttaatggcatttatttaattacccctttccttcgatcagacttaacagcagaactaaccacctacattcatcagaaagaaaaggagtcaaacatccatgtcaactatcactgaacagctgaagaaacgcatcctcgtccttgatggtgcaatggggaccatgattcaaaatgccaatctcacagcagaagactttggcggcgaggagtatgagggctgtaacgagtatttgaatgtgacagcccctcacaccatccgcacgatccatagagaataccttgaggcaagcgccgatcttattgaaacaaatacgttcggggctacaaagctcgtccttgacgaatacgggcttggccaccttgcctatgaactcaatgtacgggctgcccagttggcaaaggaagaagctgaccgtttctccacgccggagcagcctcgatttgttgtaggtgcgatgggtcccactacgaaaacattatctgtgacaggcggcacaaccttcgatgagctcgtcagaaactatgaagagcaagcacgcgctctgattgatggcaaatgtgatgcccttcttttagaaacaagtcaagacatgctgaatgtaaaagctggtttcaaaggcattcaggaagccttccagcagacaggtattgagctgcctctcatggtatcaggtacgattgaaccgatgggcacgacccttgctggtcaggatattgaagccttttatatttctcttgagcatatgaaaccgatgagtgtcggtctgaactgtgcgacgggtcctgaatttatgacagaccatatccgcacgctatcttccatcgccaagtcagcggttagctgctatccaaatgctggtctccctgatgaagaaggtcaatatcatgaatccccagcttcacttgctaaaaaaatttccgcctttgccaaggaaggctggttaaatattgttggcggctgctgcggaacaacacctgcacatatacaggcattgtcagatgaagtacgcacgattcagccgcgtcacatcacgcatgaatcgtctcagcatactgtatcaggaattgagcccctactatatgaggaatcaatgcgacctctttttgtaggagaacggaccaacgtgattggttcacgcaaattcaaacgactcattgcggaacaaaagtttgaagaagcgtcagaagttgctcgtgcacaggtaaaaaacggtgctcacgtgattgatgtgtgtctcgctgatccagaccgcgatgaggcagcagacatggaaggttttttacaagaggctatgaaaaaagtcaaagccccttttgtcattgattcaacggataaacacgtgatcgaaaaggcgctgacatattcccaagggaaagccatcatcaattctattaaccttgaggatggcgaagaacgctttgaagaaattcttccacttgtgaagctgtacggtggtgcacttgttgtcggcacgatcgatgaaagagggatggctgtaacagcagaacgaaagctcgagattgcggtacgctctcatgatctattaacgaagaaatatggcattcccgcaagtgacatcatttttgatccacttgtctttccagtggggactggagacgagcagtatattggcgctgccgaagaaacgatcaaaggcatcaaaatgatcaaggaaaaactgcctgagtgtctgacgattttaggcatcagcaacgtgtcttttggactcccgcctcttgggagagaaatcttgaatgctgtctacttgtatcactgcgtccaagcaggacttgactacgccattgtgaatacagaaaagcttgaacgcttcgcttctattccaaaggaagaaatcaagctcgctgaaatgttgctctatgaaacaaatgatcaaacccttgctgaattcacccaattttaccgcggcaaaaagaaaacggagaaaaaaccaaagatctccttatcacttgatgaaaggctggcactctatgtcgtcgaaggaacaaaagaaggtcttatcgatgatttatcccttgctctacagcaatttgaatcaccacttcatatcatcaatggtccgttaatgcagggaatggctgaggttggtcgtctttttaatcaaaacgaactgattgtggcggaagtgcttcaatcggcagaggtcatgaaggcttctgtatcgtatctcgaacaatatatggaaaagcagcatgcaagcgggaaaggtaaaattctacttgccactgtaaaaggagatgtccatgatattgggaaaaaccttgtcgacatcattttgagtaataacggctttcaagtggtcgacctcggaatcaaggtgacaccgcaaacattgatcgaagctgtgcaaaaagaaaagccagatatgattggattatcaggattactcgtgaagtcagcccagcaaatggtcctcaccgctcaggatttacaaaaggcgaatatttcagtgcccattttggtcggcggtgctgcactttctcggaaatttacgaaaatgaagatttcgcctcattatgacggacccgtcctttacgcaaaagatgcgatggacggcttatctttagccaatgagttaaaagcaaatcctcttcagtttcaaataaagccagatgaagagcctgtggctcctgtcaaagagaaagaaacaaagcagccacaagctgtcattgaattactagaaaaacgtgcggcactccctgaggcacctattttcacaccagaaaatacggcacgtcattatgtaagagacatcgacctgcatcacattatgccttatgtgaatgaacaaatgctcattggccaccaccttggattaaaaggaaaggtgaaaaagctgttggccgaacagcatccaaaagcattggaattaaagcagcttgtcacagatcttctaaacgaaggcagagagaaaaactggtttgcgcctgcatttgtctatcaattttatcctgccagttccaacggaaatgatctgcatatttatgatcccaaagcgcctgaccgtatcattgaaacgttccaattcccaagacaggagaagcttccatatcgctccatttctgattatgtgcgggggagcggtgaaaaggagaaagattatattgccttatttgctgtcacagccggagcgcgtatacgtgaagtcgcgcagcaatttaagcaagaaggagattatttaaaaatgcatgcggttcaagctctggcgcttgagcttgcagaagggttagccgaaagaacccaccaagtgattcgtgacaaatggggcttccctgacccagtcgatttcacaatggaaaaacgattccaagcgaaatatcaagggcagcgctattcctttggttatcccgcttgcccaaatcttgaagaccaagaaaagctgttcaagctgcttcagcctgaaaaaatcggcatccatctgacagaaggatttatgatggaacctgaagcatctgtttcagcaatcgtcgtttctcatcctgaagctcgatattttaatgttcattaatgcaggacctccgaaattggaggtccttttttgatggggagattagataaacttcaatttttacagtataccttcttatggtacgatacacatagatgaattcagctaagaaggagttgcatgtcatgacaaacgttgttcaacgagcattaacgctcgatgacataccagatcttatcgcattgtcacaagaggtagactggcctgattacaatgcggaagagctcacatctcttttaacaaatgggtatttcacaggtttttcaacggcggatggacaagtcatctcatgtgcaggacttttccaatatgatcgaatggcatcaattggtgccgtcattgtatctaggacacatcgcggcttaggtcttgcaaggaaaatgattgacaccctgctagatcaatgtgatcaaagcattcctgtctttttaaccgcgactgttcaggggcggcctgtttacgaaaaaatcgggtttcacacggctggttacattacgacttacaaagcacaaaacccgaaccaagaagcgcttcgtgtgtcagatgacatttacctgtctcctgccgatgaatcgcaccttccgtgtattgaagcactagatgaaaaagccgcaggcacaaatcgatcaagctttttaaaaaaccgaatgaaccgggcaacgcagcgtatcattgcaaagaatgaacatcacgaaacaactggctttgcgtttggcgttgaaacacctgccaatttaatgattggaccgcttgctgcaaatgatgaacttacagctctctcgctgattcgttcgctcatttcgtcttattcgggtccgattcgtttagatatgcaggaagaaacagctgagcgcctccatgaatcacttgttgaagcaggttttacgaaaacaaacaaagctcattttatgatgattcgcggaaaagaaaagctgaacgatcccgcccttctttatttccttgcctctcaagcattttcgtaatatataaaaagctgtagacacttgtgtctacagcttttctattacttctcacaggtggacgaaagaacatgtgcgagtgcatttgtgacctttccatgctctgatgcatgcgggcggtcatctccgtctccatacccataatcaatcattcgattacgatttaagcacagctttgtcagcttcggctggaatagatcaaagagttcaaaacggtccttcagctgtgggaattgcttttgatactgctgaatttcttcggcaagcaagctccaaagtgtcacttcatctaatagctgatggttctctaacacgtttgatacgtaacgcaggttgcaaataaacaatcctgtaaagataaactgcactaagccttccggcggttcactccgcagcacttcttttaaatcgtctcctagagaagccaattcaggcagcggctgatcactaatgttcacatcgtcaacaaaatctttgatcgccaaacgatgaggctgatgatcttttaacacaagaatcgtattttgtccgtgcggtgaaaagacggtgccgtattgatacataaaatgtagcagtggcggcatgaccacatggaaaaatttcgccatccactctttagctgagagacctgatttttcaatcagctgtttcacatatggctcaccttcatgatcctcataggtgagtgccgcaagtgtaacaggggtctctccttcatctaagtacgagtaaatgctttctctaaaaatcacaccgagcatctcaagatattgatacggcgcaccaggcagtttgctatagtaaggatgatcgacattaatacttgcattctcaccaggtaatatcacgcggcagacatcagataaaaatgaatcttggtccgcaatccctttaatatgcgctgtaatacgaggggcaatgactgtccgttctgacggaagtccccggtacacaagcgtatttaaaatactcattggcagtttaatatgatgcttgcctttatttgagatgttcgtaaaagttctgatcgactgctgcgggatatattggtccagtccctctcctacatacacaatccggcgcatcgccaaatcttccgggaaatgctgaataatcatgtgtgtccactgccacttatgaacaggcatcaaataataatcagctacaatcaatccttcatcctttagcacgcggtgaaattgacggatcgtgacttcatctaactctttggcgattacctgctcatagttttcatgatcgactgcatggaatgtcgcaaggtcccggtgaacagcaatccaagacagctgcacactttcttgcctttcaggtgcataggctaggtagtcatcgtaactgaatccaatgcgtcctttgttatacacaatccaaggatggcctgtcatctctccttcaatccatgcataatcagtatctgttaactcatccgcacgaagtgcttttttcgaaagcaaatggacatccgctaacagggtatggtgaagctcttttataagatgtcctgttgtctcagaagacattggaatgagcggctgaatgtctagtaaaaacacgattgcactgacatcctttgaccactttccatcttgacagcactcgattgattcagcgattgtatcaaaactatcaaacaaacgaggttttgcaagatagcgatatttcttctgttcgtgaataattaattcatactgagcaatgccatccttatgatctagctgcacgggatgaagcatatcctcatacatgtattcagacagcatttttgctaccattcgctggtttgcctttttccaagcagcaggattcaccgcttttttcaattcatcttgtacactcatcgcttcatcctccttaacctttgatttcttcaaatgtgttgacgttcatacgtgtaccaaatgtctggaagacgtgcttttgataaagtggatacacagtttgacgagcaagttcattgataatcacactatttcggtaagcaccaagccctaaatccggggcgccaacaccatgtgtatgaagctctgcattttggacaaatatatcattttcacccattgtatttgttttcaagcgatattcacgttcaacttggaaccgtccttgatcgtcccattgaatgtgatgagaaattgggttgataaacggcggcagtaccgattgatagcccgtcgccagcacgacaatatctgtctcgtgggtaaaggagtcctccttgacccattgcgtgcatgaaagggacaagccgcgagatgtttcctcaatcaagttaacctccgtcatcgcttgaagcactgtgttcaactgctttccgcaggcagaacgttcatatagcaaatggtaaatatcacggatcattgcagagctgatgcccttatacagcaagtcctgctgctttaacaacgcatccttttttgtttgcggaagctcataaaagaaatcaatataatctggagagaaatattcaaggccaaggtttgaatattccattgggaaaaatcctttagagcgtgtgaaccagtgaatatccttcgcctcatcatctgataaaatatcatagaacacttctgccgcactttgaccagagccgatcactgttacagatttccctttgaaacagccttctttttttcgttttaaatagtcggcggaatgaaaaaccttctctcctaaagctggctggagcgatgctggtatcgccggctgtgtaccaattcctaagacaagatgcttactttcaaacacctctaccgtttggtctttcacatgacgaacatgcacttcataacgcttttctcctgctttctcgatcaatgagacagattcgacgttcatgccaaatcggcaagagtctaactggtctgcgacccagcggcaataatgactatattccttgcgcgggatatgaaaatcctctagaaagtaaaatgaatacaaacggttttgttcctgtaagtagttaagaaagctatatttacttttcacatctgccatactgacaaggtccgctaaaaagggaacctgcagtgtcgtcccctcaatgagcatccctgggtgccaatgaaaggcttcacttctttcaaaaaacaaagcgtcaatatcatttacctcttcagataatgcggcaagacctaagttaaacggaccaatgccgattcctattacatccactacattattttgcttgttgaaccgcgtcatggttatacttcctttcgaatcgttctcgatcacaaaacatcaaaagacctgttttatcgggtaaattgactggttttacacgttcaaagccgcatttttcaaatacatggatcattttttcattgcaaatatccggctcagcgacgattttttctgttcgtttgttctgctcaaattgaaatgctgtcatggcctgaagcagcggggctgcaaaaccttttcccacataatccggctcccctattaatagatggattccttgatcatgcggagaaggctgatagtaagattcaatgacatcacctttgacgttgtacgcctcaaaataactcatgggtgtcccatcaattgtgcctaaataaagggtttgatgcggatcatgaattgcctgataaaaatgcttttcaaaagcaggaaacggaatattcaaatgccaaaatgggtgaacatactcctcttgcatccacttgtggacaagccggacatctctttcatattcagcccgaataaaatgaatacgatgcctcatccaatcagcgcctccttatgtaaaaaaagtggattcaaaacagctgtgtaacgagactgtgtttccagagatcctgtcagctcatccatatcttcaaaccgtgtcagcaaattcgcttttgaagggagttcctttgagcgaagtaggctgtttgtcagttcagatgcaccgtatgtttcctcatgagcgagcaatgtgtctctcacaagggcgagcaagtcttcttctttcgccagaccttctgtaccaaagccgttaataagaccaaataaatgattaaagaagaaataataacgcagtctctcaacggctacatcatctgcacaaatcgtttcacttctcacgctcaggttttggacaagatttgcgagtttatcctttttcgattcactataatagtagccttggttgtcacgataatagaaggtgtgcgggtaaccatctttcatttgcacaacagcgttttgctgatgggcttcaagcgcaagaccatacgtttcaaacagccaaagcatcggttctaacgaaatggttaaatattgcttaaaccaatcttggcttacatcattcgttgatcggccttctgcgtctgcaaggtcatgaatgatccctgctaatcgcgattttccaccatacgcatgatcctgacacaatccagcaattaagcttgctcctttttcacgatgtaaaaatggattttgacgaatgactacttcaaagccagattccgcctcttctccttgaatggataaataggcgggatcttcaatgacccggaatccagaaaatttgtcgtataaagaaacgcctaattctgtttttaaaatgcgcgacatctctacaccgcgatccagttccttttgtttattaacacgtaaggagtttgtaattttcacaggaacagagaatttgagcatgtaagcagaatccttttgatagacggttctgaaagatgaggtcgctgtgtattcagatcccatcggtcctaaataagagagtttcccttcctctatataacggttcacgaacgctttctccatgaccaccttcacttgaagcggatgaatcggaaggagcacatattctccgttttctactaacgtattcactctctctttttcttctggcacttggcgcaagagctcctctagcatgagacttgccgcagactgtgtaatagacgaatcctgaagcacaatcgaatgatgcgctttaaagtaatgaagctggaaagtccctttcagctcaggagaatagattgcttcctcctcctctgtcattccttgtctgctttttggggtaggatgcgttaaatgaccaaggagaagtgactgctcagcctcgatatactcaaaatcggcttcagaaagagcggatcgatcactttctcgctcctttaagaaccgttcaatatttcggcagcttaaaatgatgcgaagcataaattcatcctctgcatctgtacggccatattcaatgagaagctcctttgaacataaagcaacaagtgtcgtgtaatcgacgattgccccctcttgttcactgccttgcgggcgaaagcgaatcggaaaatcaaagagatgacggccaacagatgaaacatatcggatcggaatcacaagctctagatcttgttttgctagttttgcgatgaagacaagcgagccatctgctctcacctctttttttgcagatcgatcgattcctgtttcgcgtaaaaaacagtttaaaaagctttgcatggttgcattttcagccatttgtttatattgactcaacgtagtaccctcccggattgaatatgagcaatcccgatatcaacgatgtcagaaaggatttcctcaatatgtgtgattgtcgttctcggatttaacaaagtgaattttaagcatgttcggtcattaaccactgtttttgcaatgacagcagttcctgttttgaataatgtccgatgaatgattttattgacgtcatctgcttgatcgtcatccttaaatcggaatacaactgcattgatttctggctcaggattgatcacttcaaggtcatcatttctctcaataagcgcggccacatcctttgcaaaatgaatggtatggtcaatgatgtctccaaagccttcttctccaattaaacgaagagaaagaagtaatttcaaagcatcaaaccggcgcgtcgtttggacagatttattgacgagatgtagaataccatcgagctcgtcttcctttggattaagataatcggcatgataattgatcaaaccaaaatgtcttttatcctttagcaaaaatgccccgcaggatatcggctgataaaattgtttatgaaagtcaatcgtgattgaatcagcaagctcaataccgtctaacttcttacggtaggtttcgcttaatacaagtgctccgccgtaggcagcatctgcatgaatccaaagaccgtatggcttgacgaggtcatatacctcttgaactgggtcaatactgccaaaatccgttgtcccgcaagtggctactaccgcaaaaggcagcaagttctgctccttcaactcagccagcttctttttcaaatcattaaggtccattcgatgatgctcatctgtctcgactagtacgactgcctgttctcctaaacctaactgggaggcagattttttcacagtgaagtgagcattctttgagcaaaggattctcaggcggtgagattcacttggtaaccctttctgctgaacattccactgccatgtgttttcacaaaaggcatctctcgccagaagcagccccatgtagttagattgggttccaccgcttgtaaatgtcccatctgcttggccgccataagaaaacttcgcacataaccactcgagaatttcttcctcaaccaaagaagcaataccgctttgatcaaaggaatccattgattggttaaaagaacttaccatcacctctgcggcaagtgcaggaatgagcggtggacaatgcagatgtgccaagcatttaggatgcgatacatcaatcaaatgcggcaaaaggtgttcttttatatcttgaaagacagattcaatggattctccagacggttgaaatcggaatagcgattcgacactagccgctaatttcccaggcaatatcccactgtatggtcctgtgtctttttgccattgatccagtaagctgtcgatagatgtatgaagagccgcttggaaggactctcttccaagctggctttgattgataaataatgaatccactggagccttagttgattgcatcgtacacggcctctttaaaaatagcgatgactttttcaagctgttcttctgtcataatgagtggtggcaggaatcgaatgacacttccgaaacggcctcctgtctccacaattaaccctttgtcgaagcaattcttttgaataagactggccagctctggattcgctggatagcttccgtcaacatcctgtttctcatttggattgactacttcaacgccaatcattaaacctcttcctcgaacatcaccgagagcagggacttgtttttggatgtcttttagatgcgcctgcatacgatctcctaaccgttctacatgatcaagcaggttattttctttgataaatttaagcgttgcggttccagcagccattgccatttgatttcctctaaatgttccgatatgtgcacctggattccattgatctaaatcttgatcataaatcaccactgaaagcggcaggcttccaccaatggcttttgacagcacaataacgtcaggtacaattcctgcatgttcaaaggcaaacatcttccctgttcggccgatgcctgattgaacctcatcaataatgagtgggatccctttttcttttgtgattcttctcatttctttcatccattcaatcgatgctggaatggagcccccctcgccttgcactgcttcaaagatcatgcctgctggcggaagaataccactttcaggatcatttaatacgcgctcaatatacgaacttgaaatgcggtgcgaatccctcccaccaatgccaaatgggcagcgatattcatatgggtaaggcataaaatgaacatcaggtattaacccttgcactctttccttcggagataaattcccacttaatgacatcgtggcatgtgtcgcaccgtgatacgcaccatggaatgatagaatgcttcgattccctgtcgctgttttgactaatttaatcgctgcttctatggcatcaccaccagttggtccacaaaattgaattttggctctttttgcaaactcttctggcaagtgagaaaaaatttcattcacaaattcttctttaatttctgaggttatgtccagcgtatgcaatggtcttttttcatgaagcatacgttcaattgcatctataacaactggatgattgtgaccaagtgcaagtgttcctgcgcctgccagacagtcgtaaaactctctgccatccgcatctgtcacgatcataccttcggctttttgcatggctaatgggaaccgtctcggataagaccttgcattcgactctctttgactttgctgctccaaaaattgctgatttttagaaacggttttgatggacataataaaacactcctccaattgataaagattatcattttcatttactagcctagaggatgtgagatatgaaagtcaattgtattcaaaaagatgattctaaaagcatatgaatgctatattctctatttaacgagtaatttcgtgtcattttgacaaacctctactgctataaggagaataaacgcgtgagacggaataatgtagaaaaaaattacaaatcattcttcctggttcttttgttctattcatgacaaagcacttattttatatgggaaagtggatgaaagtgatgtagaaaaggaaaaaaagaaacgtcattctatattgatataaatggttataatggtataatttctctgaaacaaaaggggatggagagggatatgatgattttaacaaagcatgatcttcaccactacttagctcaggacaagaaagcattagccattaagcgcaaacgacctaagcggtttggagatgatatatggaaatatcaaaggattttacgaaaatatgaatactattctaatagtggtgctacaattcgcaaatggctttatcgctatttacataaaaagaaaggcatgcagcttggctttgatatcccgattggtgtcttcggtcccggtcttagaatcaatcatacgggtctcttaattgtaaacaagcatgcaaaaattggggcattttgtgatattcatcaaggggtgaatattggtcagaatcatcatgaaaaagatgtaccaaccattggggatcatgtgtggatcggcccaggtgctaagctgtttggggatatctatattgcagatcatatttcaatcggagcaaatgctgtggtaaaccgttccttccacgaggagaaaattgtgattgcaggtgtgccggcgcaaaaggtaaaagaaaaaagtccttcatcatgaaggacccacctgataaaaaagaatgataccgatcaaaacagagataagcagcatgaggtaaaacaaaatcgttaaaataagaatggtccagccaagtcccttcctctctgtcttgatcaaataaataccgagaacgatcgtactaaataatatacctaaaatggcccacagccatttgtctttatcatgctttggcgcatcaaaccataaataaatggcaacagcaagtgaaacgaataaccctgtaagtcgcacgttcaaactcctccttatgtacactcgtgctttctattatgcgtttgagtatccgataatcagcaataaaaagtaaaaaacatagactagaatgaaaatagaatagatgataatggacacgatcagaaccgcccagcccaatccttttcttcctgttttgatcaggtatattccaaatgtaaagagcccgaataaaaggcctaaaatcgcccacagccatttattcttcccatgtttaggcgcatctacaaataggtaagcgcccactataatcgacacaaaccatccggtaatccaacgcaactcattcgccatccttcatttttagattattcaatcatacgctacttttgtactaaaaagaaaaggaattattcagttgaatattgcagaaggcttttccattcctcacgcagtatcccatagcgcatcgaatcataatattctccttgatagtaacggacctttcgcagtcttccttcaaggacaaatccgcatttctctgcacaccgcatcattcgttcatttcccgaccatgtagtaagaccaattcgaggaatatcaatgtgtgtaaataactcatctgtccatagacttaacgcctttgtcccaacgccaccgctccaaaagcgcgaatcataaatgagaatgccgcattcaagccaacgtgtacgttcattctcccaataatatgacacggtgcctttgatttcgccgtctatttcaataccatatagctttggcggaatggatgtatcctgtaagtatcgttttttaaaggcagcaagcgggatttcgtgttcatgaaaatatggggcattccactttcgataggactggtctggtgctttgaatcttaaatgccataccatctctaaatcagcttcatttaatggtcgtatgctcacaagcttttccttttcccttttcatctgttcacgttcctttactttgtcgttctttttgcgagatgacggtactcgataggggtcatgccttcgttttgacgaaacagcttagaaaaataagtagggtcatcaatgcctacctgttcagcaatcgctgcgatttgattattcgttgaggcaagcaggcttttggctttttcgaccttgagacgattgatgtattgggttggcgtgagtccatataccgtctgcatgcatcttgttatgtaatcaggatgatagtgcagtttctctgccagctcttccatttgcagtttcttcataaagtgacgctcaagataatgaaccacttctgaggcgacattctcctttgcacttggaatatgaaatgcttctttttgtaaatgaatgagcagttcttcaaactgaagctgttttttcagcggcagttcagacgcgtcatcatttagtgcccgcatctgtgcaaggtgcttttcaaatacatttctccccttcacttttcctatacgggacaggctaaattcatatgttgccggcttttcaaaggtggcttgattttgtttcatatcaaaccagtgttctctcggccgattcgtcaaatcaaaaggatcaatcgaaaaatggagccactcatagtgcgtttcttcttcgcatggcaggtgtccgccatgtgacaagcctggtgagagaatgatatattctccttcttttacgtgatgagcctccctgtcttctgtgatccatagctgccctctcgtgacataaagaagatcaaacacggtaaaggttctagagatatgtctttctccttcataaaatacgcctttgccagaaacgatataaaccggaaacggcggtacagtaaatgtaataaatcgattcatattcatccccttatgaagtcggatttctccaataagtttcggtttcatctcttcttattatagtcgatgcaaggtacactataaatcggatttatacgaaaggaggttgattgatgaaacctcaatcactgccaattcaaaaagttcaagctagagggaagaaaaaccacccttcattatttgcattaacttggcctatttttattgaaatctctttatatatgctcatgggaagcgctgataccctcatgctcagccaatattccgataatagtgttgccgcagttggtgtaagcaatcagctgctgaatttattgattgtcatgttcagtttcattacaactggaacgacgattgtgattgcgcagcttttaggagcaagccgcaggcaggaagcggctcaagtcgcctatgtctcactaggaaccaatttcttgattagctttgttattagtcttctcatgtttgtattagctgtccccatcttacatctgatgggcctatcaagtgagctcatgccggatgcgactgtatttttacaaattgtcgggctgctttcttttattcaagcgctcattatgacgtatagtgctattttaaaaagctatggatatacaagagatacgatgtatgtcaccatcggaatgaacttgctaaatgttgctggaaactatttggtgatttttggtccgtttggcttccctatattaggtgtcatgggggtcgctttttcaacctcactcgctcgattgatcggattaatggccatgatcctcattgtacgccgccgaattggattacacttttcactaaagaagatgtttcacatccagcggacatatttaaaaaagctgctaaagatcgggattccttctgctggagagcagctttcttataacggctcccaaatgattattacactatttattacatttatggggacgcaggcattagcagcaaaggtttatactcaaaatatcatgatgttcattatgctatttggtgcagccattagccaagggacacaaattttaatcgggcgccatattggggcgaaggaatttgatgctgcctatcacagatgcatgaaaagtttatactgggccattggcatctcccttctttcttccactgctttatctttatcatcgacgcatttgcttgctttctttactagcaacagcgagatcattcaaacagccgccaccctcctccttttgaccattattttagaaccgggccgttcgtttaatatggtcattattaattccttgcgggctgctggggacgcgaagtttccagtgtatatggcgatgatttcaatgtggggcatcgggcttccgatcgcttacttgttaggcatacagcttgagatgggcctcattgggatttggatttcttttatcgtggatgaatgggtgagaggcatctttatgtataggcggtggcgttcaagggtttggacggaatatcgcttttcatccacataaaaaggactgcgagtgcagtcctttttacttaataccttctaaaataagtgctttttcttggtttgaaataaatgatcgctgtgtaaatacgcggtattcattttctcttgttttatctaaaatggctttataaaagtgagcagctgctttcactggtatacgtgaataaagcgggaattcatgaagatggtcaaaaaactcctcgtagtatgcctctgcctcaaaggcaatgtactcccatacgtgctgaaatgcttgattgacaatgccttcttgcaattcttgctctgtatatccgaattgatccatgacttgctttggcaaataaatgcggtctctttcagccttatcctcgccaatgtcacgaagaatattggtcagctgcatggcaatccctaatgaaatcgctgcttcttttagctgttcttttttacgcggtgcaattataggaagcagcataagtccaacggtactagcaacatggtaggaataaatgagcagttcatctaacgtttcatatcgatgctgctctaaatccatctcctgaccttggagcaagtcacggaacggtgcttcatccatacgaaaatcttgaaatgtatgttccaacgctacccacatcggatcattccgatctacctcaccttgtaaaaatcgatcaaacgtctctcgaaaggaggcaagctcctcttttggcgagggtgactcatctacaatatcatctgctcttcggcaaaaggaatacacggcccatacagcctgtcgtttctttttaggcaacatggaaaaggcacggtaaaacgttttggaatgcgtttgaatggtctcctcacacaatttcaatgctgtttgtacatcaaccacttagtttcacttcctttctgtcattcaaatcttttaacagcaaagatgtcatcagcttcgcactttgcatcacgatcggcactccgccaccaggatggatggaagcacctaccgcataaagattatcggtctcagctgccttcacttgcgggcggaacacacctgattgaaataagttaggcgcaagtccaaagctgccgccttcaaacaacccttcccgcaaggaatcatttggtgttctgacttttttccagacaatcgactctcgcaatctcggaaagcctcttttctcaagacgatccatcattttctctacaaaatctgtctcctcttcccagttgatatgatctcctgagggaacgggaatcagcatatataaaacactacagccttccggggcaagagatggatcaatgatcgatggattaaatgtataaaacgacggatcttgagggatcgtcttcgtttgaaaaacctctttcatatgctgttcaaagtgttcgcccataaagaattggtgaacaggcgcatcatggtacattttgtttaacccaagatacaccatcacacaaccagaagatggcacgtattttcgccgatcttgttcgtctaaactaagctgttttaacgcagccggataatctccgttgatgacaaaagcatcagctgctatctggtcgtcaatgacttttgctttaaccacgcgtttcccctcaaactcgagctccgtgacttcagcattttttctcacatgcacacccattttcatgagctgttcttctaatatatctactaaactcgcatagccgccttttaaatagtagatgccatgtgcgtgctcactatatgaaacaagcgaataaatagcagatgcttcatatggatttcctccgacatagagggtttgaagtgcatatgcatctcgcaggcgttcgtctgagaaatactttttcagagcactttgaaccgtgcgatacgcctttaatttcattaaaatcttcatatttgcttttgtaaaaaatgtccgcttttcatgaaatgatttctctaaaaaggcttgctgtccttcttgaaaccggtctgtcatttcttccataaaccttaggaatccttgatcttcctttggaaatacacgtctgatttcctctagctgacgaagtgcatcagaatacttcgtgtaggaggttccatcttgaaattgaatcgtatacagcggatcaagctgcaaaagatcaagagatgcttcgtcaattcctacctcatgtaaaataccttttaacatagctggaagtaggacaatggtcggaccttcatctactttatatcctttctcacgtacaaaagcaagtcttccgccaagtcgttcatttttttcgacaagcgtcacatcatgtccagctttttttaaataaagtgccgagatcatcccgccaataccgccacctgcaatcaatatatgttttttcatgaggcgctccccttttcttcttgcggcaatgttttgtgcgtatgtttctcttttgaaagaatcgcatttgtcgtgatacgtgctgattctaaaatggtcggcagtccgcttcctggatgcgttcctcctcctacaagccagcaatgatccaattcatcaaattcattgtgcggccttagaaccatcatctgcgtcagctggtgaccaaggttaaaagtggctccttcgtatacgtaaaggtcttcctcccattgcttcggtgtgatcatccgctcgacttctatatgctgccttacattcttaaaaccggtttttcgctccagtgtatccagtacaagttctctgaattcatcttgatgcgcttcccagtcaatgctgctttgattattggcaacgggtgctaatacataaagagctgactttccttttggcgcaagtgagtcatctgtgacactagcattttgaatataaatagatggatcatctggcagctcatatgttttcgtaatgcctttgacgaattgcgcataatcatcagaaaaaacgatggtatgatgcggctcctcatacatggtatctaaccctaaataaagcataaaggtcgagcatgagaattttttcttttttaattttttctcactatatttctttaaaagtcctggctctacaagctttgtcattacatgtgcaaaatctccatttacgacaacctcatctgcctgtatttcttccccggattctaagcgaatgccctttactttcctgccttctgtcagcaacttttcgacgccggctgacaaatgaatcgttgctccagcatcaaccgctgcttttgccatcgcttctgacagctgattgaccccgcccttcggatggaacacacctgtgtcatgctccataaatgatagaatggaaaaagcacccgggcattcccacggtgacatgcctaaatactttgattgaaatgtaaaggcatatttcactgattcatttgagaaataatctgacagcacatcatataaactcttattcaatgaaagctgcggaagtgctttgagcacctttggacgcaaataatgatgaaaacgatccattttactttgtaatataggtgtaagtcgatccattttgcgtttcgtatcgttcataaatcgtatatacccttctccctctccaggcgcaaaggcttctaaccgtctaaccatttcatcacgatctcgtatcatatctagctgatcgtcttggaaaatcaatctatacatttcttttaattcgatcacatcaatatagtcataaagatttttaccagcaaaggtgaacagctcctctgcaatatgaatcatgctgagaaaggtaggacctgtatcaaacgtgaaatcaccaagttgaaacttagaattacgtccgccaacaaagggctgtttttcataaacatgaacatcgtgtcctttgctttgaagcatcatagctgccgcaagtccccctggtcctgctccgatcacaatgattttcattatcctttttcctccaaattaattcactttaagttaattatacaaattagaaagattagatcaactttcgatgtgctctatttgtctcatgttatgcatcaaaaaaagccggcttcccttcaacaaatgtaagaaagccggccctttattacgcttctatatcaattcgatacgtctcaaaccagtgatgaatctgcgccagatgagcgattaattgcgggcccttcatgagctggccataccaaggtacttgaaaggaagctccttccgtttcaatcaactgctttaattgatgtggatctagaaattcgtgaagaacagaatctttttgcgcaaggcaacctgttaacatctcttttacagcctgagtataggctggatgatgtgttttcgggtaaggactcttcttgcgataaagcacttcattcggtaaaattccctctaatgctttccgtaaaacccctttttcacgatttccatgcattttcatttcccaaggaatattccatacatattcgacaaggcgatgatccgcaaatggcacacgtacctcaagactcgcccccatactcatccggtcttttcgatctagcagcgttgtcataaaccagaccatatttaagtaaaaaagttctctccgtgctttatctactccagtttctccatctaaaagaggcgtttcagccacggtttcttcatatttgctttgtgcatattctcttagtgacagctttttttgccacgagtcttgtaagagctgcgttctagcttccgtcgatctcatccaagggaaaccattcgtttcatttgccgaatggaaccaaggatagcctccaaaaatttcatccgcacattcacctgacaaaccaaccacaaagtcctttttaatttctcggcagaaccaaagcaaggaagaatcaatatctgccatacccggtaagtctcggacctcaaccgcttcctttaaataagcagccagatccttttgtccaatgatgcagctgtgatgattcgtttgaaatgccttggtcatgcggtcaatccatggaccatccgcattcggctggaactgacttgcttcaaagaattgatcattcccttcgtagtcaacggaatacgtatgaagcggtgctttccctattttctcaaagtgcttagcggcaatggcggtaatggcactcgaatcgacgccacccgataaaaatgtacaaacaggcacatcagagacaagctgccttgtgacggcatctgtaaagagatccttgacgtgctgtgcggtgtcatcaagtgagtccgtatgcgccttgctttggacattccagtatctccacacacatagtccgtcttttgaaaaggtcaaggcatgagcaggtctcagctcttttacccctttaaacactccttgccctggtgttctagatggtcctaatccaaaaatctccgataatccctcatgatcgacttttgctttcatatcagggtgagcaagaagcgctttgatttctgaaccaaataaaaaggaatgatgacgttctgtatagaaaaatggcttgacgccgagccggtctctccctgcaaataataattcacgctcactatcccaaatcacaaatgcaaaaataccattaaaatgggtcacacactcttccttccattctgtgtaggcgtgaagaagtacctctgtatcagaatgcccaaggaagcggtggcccctttttaacaattcttttcttatatcttctgtgttatagagctctccattatatacaacggtataagcatggttttgatgtgtatatgtcatcggctgttttccgccttctacatctacaaccgctaaccttttatgcccaaatagaacgtgctcacttttccacgtatttgtatcgtctggccctcttttagataatgtatctgtcatttgattgattacatgatcctgttggatgagctgctttttaaagtctgcccagcctgttattccacacatcatcatcagctcccatccgtttttcctcaagtgttctcattcagcctttcttagtttatgcatcgtctcctcgatagttgatttgtccttttttctcgggcgtataggacaagcttgatttggtaagaaaaagaaagaggaaaggagcgtctgcaaatggaaaaacgaatgaagcagcttgaacgctgcagccgaagatggtgtagcgggtatttactcattgaaaatgggcattgtctgattgaagatgaagaaggagaattcatgctgccagaaagtcttcaaagcacgatgatctgtttgaaggagaatgataggtggataaaaggagagctgctcggttccatgatacttcatgaaaatggacagctgttagaagtacaaggcggtgaagaaattcaatatacggcatcactcgccaaaggcttgcttgaccttctcatgtttgttcctgaaaacgtcttttatgaaatcattgcacagatcgagcagcttggcttttccgtctatgattgtgttttctcctcctttcattcttttcaacgagttactttctttcagttttcgacagatacacaatcgcttgcccttcaatctcaccacgactcaactgcaggtcaaattcggtttgaatggaccacttctgacggtcaccggtcggtttcacagtttgatggcatataaaaaggacactgcttcgtataagcaatgtcctttttctgttaaaagatatgaaaaccaatcggcagacgtaaaccgagaagaatggtcacgatcgcgagtacgataaaaccaatcaatacaccagtcaccgattttccttttttcttgcgtacaagagtcatttccatgaagccaatcacaaggataccgagaatcattttaccgatatactcgccaccgaaacctggaatcttcattcctgtgcgaacatacagctctacgcctgtggcgataatgatcaagtacaatagtctgacaatcatgtgcacaattttagcacctttatcgtttttacctgctagagcaaaggccacgaagaataaaataattcctagcacccatgctgtaatatgtaaatgcgttcccatttgttatttccccctttatcagaacaattaccttctcatcgtaccacgaaataagtcgaacacaaaacgacaatcctgtgtcatattactctttatttgacgcgatttgatagcgttccaatcggttcaatcgtaatatcgatttgatcccctgaagctaagaatttaggcggttcaaagcctttgccaaccccagaaggtgttcccgttgcaatgatgtcaccagcttctagtgtcatcccttttgaaagagtagacacaatgttctcgatggagaaaatcattaattctgtacttgcagactggcgaacctctccgttaacctttgtttccacatgaagcgcgctatgatcctcgattacagacttatgcacaatataaggtcctatcgggcaggttgtatctaagcttttccctataaaaaattgtttgtgttttttctgtaaatctcttgccgttacgtcatttaaaatggtgtaaccaaatagataatccttgacttcttcaggtgcaatattctttcctgatttgcccatcacgatcgcaagctccccttcataatccagttcactcgtcacatcttcatgaaggaggatatccgcttcatgtccaacgactgaagtaggtgcctttgtaaagatcatcacatctttaggaatatccgctgcacttcccatctccatgacatgatcttgataattctttccaacacacataatgtttttagctggctttggaatgggcgcatggagtttcacgtccgacagcggataaacataagaaccgcggtcttcttcttttttctcagcccagtcaaggagctgtttgacatgctcaacaaacttgtcccccatatgaatacattcagctaaagagttcggcagtgtctctagctcgaataatttggcttctgcctttttgacgtccatgacccattcatcatcaatgactaccccaataaacatcctgctatgtatctcacctgtaaaaaacttcatgtcttcccctcacaatcttcatttcgctaagtggtgatgtctcattttatttctctatgaaataaaaaaaacccttttttatcatactctcttttaaaaagggtttcaaaaaagatgatctgatgtttagcggtagcggcgatactcccacatgttcccttgatcccatttacgatcaacatttcctctgctgcgggaatgatgctttttctttccacatcttttgcaagagtggctgcggcgcgacttgtggctcttcttatgatgggatctgtgcttgctgcgatgtgacttgcggcagctcttcttatgatgcgatctgtgcttgctgcgatgtgacttgcggcagctcttcttatgatgcgatctgtgcttgctacgatgtgacttgcggcagctcttcttatgatgcgatctgcatttgctgcggtgtgacttgcggcagcttttcttatgatgggatctgtgtttgctgcgacatgattttttcggttcgctctttttgcttctgcaagattttttgcttttatatgactttttactcttcatgcttttcttcgagcgataacttttctttgaacgatagcttctgtagctttttttactgcggcatgatttacggcgtccaccaccgccaaagaaccaatgaccgcgacttgaatgacgagaacgagctgacttatgcgaacgtctcgattctggttcacgatctaagtgatgatcacgcccctcacttttaagtgaatccactgcatgctcaatatgtgaatgatcaaatgtgctcacgaacgattcccctcccagtctatactttgacaaaacaaacagatcaagctgtttatcttctctgctttatgttacgagaattgatagacaagtgttcttggcggatgcccctttcttttaaaactccatgaatacctaacaaacgggtacaggacattccttcattttcatatcgtaaagaagagcaaaggaggaggatgaacgcatgaccacagaacctttaaagcaaatggatatttggattcatccaaaggacctgattgaattaagaaaagacatatggaacgacgaacctgttgagggcattttgaaaactggccagatcaaatcacacatttatgcttcatatcgggggtctcacatcagaaagctgaaaaaaaagtcctatcaaattgaatatcgaaagccaaagcaaagacaaggcgaatcgatctttcatttaaatgcagaatacaatgacccttcgtttatccgaaacagactgtccttttatttcttcgagcagataggggtgctaagtcctgctgcggctcatgtgtttctcacgataaacggaagaaaagaaggcatttatttaaaaatagaatccgtcgatgagcacttttttcagaaaagagagctttcagaaggcggcatttattatgcagtcgatgacgacgccaacttttctcttttgagttcatttgataaaaagccaaaaaaacaccttctcctcgggtacgagaaaaaaacagggagttctcaacatgatcaacagctgagtgaatttatttactttctcaacacagcgaaagatgacatatttgccgaaaagattgggcattacctagatgtgacccagtatttccgctggctcattggtgtcgtgtgcacacaaaactttgacggctttgtccataactacgctctttatgtgaatgaacaaggcagattccaagtgcttccttgggattatgatgcgacatggggccgtgacattcatggagaagaaatggcgtttgattatattccagtaagcggctttaatacgttaactgctagattactagatatccctgcgtttaagagagcctattacacgcttttccagcacgtactcgatacacattttttagaagaccggctttgtccaatcattgagaaatggcatgcttctattgagaagcgaattggagatgatccttatacaagagaccgaaaagacattctacgatcagaacgagagatcatccggcagtatatcaacaaaagacgacgttatttacagactgaaataagaaaagagagagatgtcacgtaaggacgctttcgaattttgtcactttattactcatattgacgaaacaactttttttatagaaaaatagggtatactaaccatatccttctatttgataaaaaatgtgagagttggcgtccgttatgatcaattatgaaattgaacaaaaaagattacatttaattgagaccgcaaaaaaattcgggatgaatgccgaagaaaccatcaggtgcagtcaagagcttgacacacttttaaataaaggcatcaaatacacctcgaatgaatgctctaaaaaagggtaaaccatacacctcattcctctcaccaaaagctttcaaaaagacaatcacacattaaaagacccatcataagctatggtgaaacgcccaaaaacaaagtgccttatttttataaaggatgtgcaccgctatgccggctattgttggagcctttaaagtaaatgccgtcggaacgagcggagtcgttcatgttggagactgcatcaccatttctccaaatagtcaggttaaaacgtttgctggcgcaggcagttttaacactggtgatcaattgcgcattagcaactataaaagtgtgacaaatacgtatgatagtgatgtcattgatcaaccgcttgttggtaacttgtaaggagtgagaatccattgaacttctatattaatcaagcgatacaaattaattacttacgagtggagtctgtgagtaactcatccgttctgcaaatcggaagtgctggatccatcaaggcattatccaatttgtataacactggaagctacgtagaatcagcacctgccgcagcaggcacacaaggcattgcagaatctcaaggcgcaaccacgacaccttttgtaccgcttcagtcaccaacaacataagttcatctgcaatccccggaggtgtatgcatatgtatgactatcaaaacaacgcttcacaaatgtatggcatcattcaaaagcaaacacagcaaatcatgatgcttgaaaaaaggcttaatgagcttcagcaggaaatgcaaatgatcaaagataaaccgacaacaacaattgaacggattgattatcaatttgatcaactgaaaatcgagcggctggaaggcacattaaatatcggcctcaatccatctgatccaaatagtgttcaaaattttgaagtgggtcaaacaacaaccccgggaattggaatgatgcagcaagaaatggctgatcaatttttcaatcaaacacgccagcttgtcgatgcattcttaaatgaagaagcaccacagcttcttgaagaactagagcagcgatacgaaggctcgcttgatgaaagcaacaagcaccatatcattgaggacattcgaaaacagatagacagcagaatcaaatattacgcgggacagctgccacaaagggaagatatgacaccacttcaacgttccgagcaaattgctgaatatgtgaaacatgatgtcaaacgggctatcgaacactttttagcccatattccaaatgaaacgaaaggagaggaaaacggatgaatttcacagtcgtcaaccgcaacatcgaaaccggaagcatcaaagtagttggggtatcgtcctcttccctatttattatcggggacacagaccatgtacaattgtcatcgattttcgatacaccgccagaatcattaattattggcccgtttgttcctctatcccctcgataatgataaagcgcacatctcaagtgaagttctcgaaggtgaattctgtggggatttcgagtgtggttcaaattggtgatacacaagagttatgcccgaacgtgaaggtgttagctgttcagcgaacgattagtttgttttatggaaatgaagctgaaaacctagatgcaaaagaatttgaagtgtattatgagccaatcccattgatgctgccagaacgaaaagttagaacggccttttatcatgaaaagcctctcattaaagtttcgtcaattcatgtagaaggggtctcttcctcctctatctatcaaatcggctctacgtgcgggataaatgccgttgcacgagtaaagcatattcgagagttatttagcaacaacgacgaaaatccgccaaactcacaattggacctccctgcgcatatgatggtgatatgacttcgaataaaggatgtcgattatgccagcaattgtcggacccatttacattaactcgatttctgggggcgtcgtaaacgtcggtgactcattttatctttcgcctaaaagttcttcaaaatctgctttaggctctggagcggggaataccggagatttcttgattttaaataatggcattagcgccactaactatgtggatcctgacttaaacgatcagaatatggtaggcaatgcataaagcggctcctctacatccatttcacttagaggagcgcttttttatgtttatttctttctacgttgtcttgatttctttgttttgaccaacttacttgccggctgctttcgaatccatttgatgtacggaacaagcttttcatcttgtctaagcgcatcaagcgtgttcaaacgtgcggcaagctcctgatttgtataaagagcatgtacttgtttatggcaagggatgcacaggaaggcagtcggtaaaaaagccccaccttcttctcttggtgttaagtggtgttctgtgagcaggacattttgtcttccgcacagctcacataatccaatggtttgctttgccaccctgtcatcacctcaacatttacatcaattccattgagaccgttgtccctttcccgcttggatctgctggatggacaatcagtttcttcggtagcctcattttcaattcttccacgtggctaataacaccaactgctaaattgtgagactgaagcttttctaatgcggtaatgaccgtatcaagcaagtcttgatcgagcgtaccgaatccttcatcaaggaaaaagaattgcagcgggaattcacctctcagctgaatttgtgcagaaagagcaagggcaagagccagtgatgtcaagaaggtttccccgccggacaagctggacacgggacgcctaacaccgccatttgcatcatcacgcataacaaagccgccttctgagtcgacctcaatcgcatatctttgtctcgtcaacatacctaagcgggcggatgcatcacgactgacactttccagctgttcttctgctaaaaattcaacaaacgtattccctttaaaaacagtttgcagtttatcaaggcgatcaatttcttgctgcagtgcttccaatcgttcgtgaatacttgcaaagcgctgatgattctcttccatcacacgcaggtgttcatgtgcggacccactcattgcagtcgcttcttccaatgctttttcagctgcctcttttctgtgctgaatgtccatccactgcttttcatccagagactcttctttcaataattcagaaattcgctttaagtttgcggcacattcctttcttttatcctcaaattcctcaatttcttgtttgaccgattgacgtactgcttgttccattgaaacagactcaatttcctgcggcatatgaaaaggagaagattctgctgctgtttcccaagctgctgctgtttcttgttttcgcttgttcgcctcttgaagctgacgctcactgcttgaaaaatgactttgcgcctcactaaacaactgctgcgcgtgctgcaattgcttgtacgattgctgctctttttcattaagaagagaaagggagtgttcaacctctataagttcatcagaaatagaggcagcttttaatggatatcggcctaaatctatttcatattgttggataagctgctgttgactttctaactgatgcgctagtttatcaagttctttctcgacattgtatatcactgtctgcagctgttcttttgctagctgtttttcttccaaaaacgaaatacttttctcaattcgttctttatagccttccgcttgttggtccttttcatcgatttgcttttgcatttcttgtacttgattcaatgtaagatgcgggaaggtctgttcaaattgagtcgtttgctctgaaagctcagcatgaagctctttgatcagcacttctaattcttcaatgcgctgctgttcaaaagtcatttgctctttcattttgctcatctctgctgattgatcatgcgtttcatccattaaacgagctcgtttctgttcaacttcttgaatatcttgctttatgcctttccattcttgcatcagatcctgcaaagactgcgaattttgtaccatttctactgctgcagcgacttccgctccaggggctttctgagataagaaagcgaattgcttcactaattgattggcatgcgtttcgagaagctgctttgcggcatacatgtctcttccataatcctctgcctgcttgagctctttgtccatccgttgaatgacttcatcgacttgtgccacggtttcttcatggtcattggattgcaaagcctttggatcatgatgaatcgacccacaaaccgggcatggctcaccatctactagctctgctgctaattcttttcttaattctgccgctcttacagcatctcgctgctttaatttttcgagtttctgttgttgttctttttgactccattctgtcagagctcgttcgagttcacatacataaaaatagaggtgttcaattgcttgaaacgattggtctattttttcatgatggtcgttttgctgcttttgaagcctttcatatgcttctgaagtctgtgaggctcgcttgttgaactcctccagcttttgcttttccttttgaatgctaaggtttattctttcaacattttcacttaaacgtaaagcatcctgtacacttttgcgttctttcactgaaacttgtaactgctccagctcattcttcagctgtgtttgtttcgttagtgcacgctctaatagagattggagattctccgcttctttcttcttttggaggagctgctgcgctttttcatttttttgacgctctatgcccgtcttttcctgaagagctgcctcttttttacgttcaatttcttttagctgaatcagctgctctttcttttggagaaggtctggctctgtctctattttcttttgccggtcttgctcatactcccgcgccatttgatcatagatcgttcgttgatgcagcagctgcttttctgcttcctgcttctctttcgatgcttgagaaagctgtttttcagcctttgtcaatgcatccgcatagggctttagcgtctctgcctgctctgcgatatggagcttcgcccttttctcttctattgatggtgccagtaaattcagcttgttttgttcagtctcgtaagcttcttgttccttttgatactgccagatcgtttgcgcctttgtaaaagcagtgagcgcttcgtcccgcgcttgttttttctcatgaaaaatagcctttgcctgctctgctgcttcatttgcttttgccagcgcctctgggccagcttctcctaaaccattcagttcagccagcagttcatttttttgtccataatgcttttgagcctttgcacgcaatcgcttgacgagctgatccccatatttctccaagttaaacaaccgctgaagcatttgacgtctgtctgccccttttaaggagagaaattctgcaaacttcccttgaggtaagacgaccgcacgggtaaaatcatcaatggttaatccgagtagttcttctactttacgattcacctcactcgctttatctgcgagaactgtctgcgtatcaccgatttcaatcaggcggcataaagtcgttctgactttcatttcatccgctcgtttgaaagcacgctcgactttataagaaatgtggtgttccttttgcaaagcaaatgtaaaggaaaccgacagcttttcttccgcttggttcaaaataccatgtgtattatttaacgcacgctccactttgccatagagggccagggtcatagcgtctaatatggacgactttccacttcctgtcggtccaaatatgccaaacacacccgcatcacataatgagctaaagtcaattgtttgttcttctctgaagctatgaagtcctttaatggtcagcgtaatcggcttcaagtcgcttcctcctcttgcatatcattggctagctctaaaaacagtttgactgttttttcatcaggcagaccgccacctgtctggcgctcataaaacttcacgaatctctcttcgatcgagagtttttccacttgcttttgctcttctatttgctgtagttctttgaattttggacgaatgtgaacaaacccactatgctgctttcggagttgatgaatctcttcaatagagagctgatctgttaaatgaatctctagatcaatccatgcctgaagatctcgtttttcatccagccactcgtacacttgactcagtccctcagtcgccttccatttcataagtggttttccgcttgataaaaacacttctttccagctcgctttttcattcggttttgcctccacaattgtgactgatttggcatagcctgattcagaaaagctataagcaagaggtgatccagaataacgagcaatcgttttggcacgtttgatcgtttgcggcctgtgcaaatgaccaagcgcaacatagcaagcggattctggcaggctttcagccgcaacggtatatgcgccgcctacttcaatcggtctttctgaatctgtttgacttcctcctgccacataaatgtggcttgttgcgatattgaccgtatccggttgaaattgagtacttaaatgttgaaacgcttgttgaatctttaaattgtaatgatcacgaagcaatttctcttcgaatgtttcagccagcacctcatttagcctcgcctcagacggataagcgagtgctgcaatggataaacgttcatccgcagaagaaacatcgacacggatgatgtcatttgtcggatatccaattaaatgaatcccttgatcatttgttaaaggagatgcggctgataagcgatccggattatcgtggttgcctgaaatgaccactacctggcgttttcctttatcagataaagcagatagactttcataaaaaagctgctctgctctagcaggcggattcactgtatcaaaggcatcaccggccatcacaatgacatcaatgtgttcgtctttcacgatttgatacagctcatctaaaaactgtgcttgctcatcgagccggcttcgaccttcaagggttttccctaaatgccaatccgctgtatgcagaatcctcatgtgattcacctctcatttcgatacatttataaagagatttctaaattcccatcgaagaaataaagaattttctcctctaatgttctgtttgtcaaacgctctacagcttttgcatataatgctatttgggtttcataacgctttttcaagatcgattcagcagcgtcaactgtatatctgccttgtactctatcagttttataatctagtaaatatagctttccatctgtttcaaataaacagtcaatcattccttgaatcagaacaggctctccctcagtatctatatgacggtatacctctttaacaggtaacaccatactaaaagacacctctcgtttcacccagtccgcttttagcagtttttggccaattgaagtagagaagaaagatgcaattccttcttgattaattgaccggatctgctcatctgttagcaaatctcgctgctgtaaagattcgagcaagtgtcctatctgtgattcatcataaggctcctcagaaggaagcgggatatgctgcatcactgtatgcattgcggtgccttgctctgcggcagtgagtgtttttttcttcatgaaagccggccggtcatacaatgttgcacgagcttttcgaatagaagaaggaacactgtactcatcctgtatttctttcattctttttatctcggaaacagactgctttgtgccgacttgcgaggccgctagatacggatatttccatgagagcctctctgccaccttctcatcagcatcaccatatccttcaacaggcagaccatccatcaatgcttgtacaatctcgtcttgctccttcttttcaagtgacatatcttcctttaaaagatcagaagcttgcgtaaatgagatagtgaatgtagacggatgtgaaagaacaacatctcctgcttcttctaaaacagatgccatcgcttgatgacggatgagggcaggtccaatgaaatctaagtatgtttttgattgataccgttcaaaatcagggagcagccactcttctccggttgcggcattttgccatttacttaatgctttcacctgatttttgacagagccgaccagaaataatttttctttagcccttgtgagtgccacatataggactctcagctcttcagataataactcttttctcatcttttttttcatcgccacaagcggtaatgtcgcataactaattctcagttcaggatggatgtacttgcttccaaaccctagttctttatcaagtaaataggactggtttaagtccatcatattaaagttcctgccgagtcctgcggtaaagacgactggaaattctaaccctttactgctgtggatcgtcatcatacgcacaacgtcctctgtttcactgaacgtttttgccgcaccaagatcatccccacgctcctgcattctttcaataaaacgaaggaatcggaatagccctctaaaggcagctttttcatattgcttggccctgtcataaagggcacgaagattcgcctgtcgctgtttacctccaggcatcccgccaacataatcaagatactgcgtgtcacggtagacttcccaaattaattctgccaccgaatgattgatagaaaaatcacgccacttgcgcaggaattggaaaaatcgctctagctttttgcatgtagggtgatcagaatgcgtcacactcataaatgcctttacagcatcataatacgtgccttttttatcacttgttcgaatcagagccaattcattttcatctaaatgaacaagaggtgatcttaaaacagcagcaagcgggatatcctgatatggattatcgatgacttttaacaaagaaagaatgacagacacctctgttgcttcaaaataaccagaggaaagattcgcatatacggggattccctgcttctttaattcctccatcatttgcggagcccacggcatagaccgaagcaaaatgacaatgtcacgatactgtaagttacgggtcatttgctgctttgcatcgtacacttgaaatggctgctccactaattcttttatttttttagaaatgattctcgcttcaaattggacggtctcgagctcttctcgctcttcgccggtttctgcttcctgctgatctaagtggacaagaagcatttctgtcgttgtatctttgctttctggataactcgctccaagctttaattcagcttgttcatcatattcaatttctccaactgtttcccccatcagctgcttgaacaaaaagttcgtactatctaaaacatctgaacggctgcggaagtttttatttaaatcgattctcttccctgtttctttgccgtctggttgaaagtgtttatatttgtttaaaaagagcataggctctgccagcctaaaacgataaatagactgctttacatcaccaaccataaacagattgccctctgcagaatgttctcctttagatacaagctttaaaatggtttcttgtacaaggtttgtatcctgatattcatcaacgagcacttcttcaaactgctgttgatagtacttggcagcttctgtttcaatcaaatgtccttctgcatcctgctccgctaaaatgcgtaagcaatagtgctctaaatccgaaaagtcgacaattgacttttcctgcttcgctctttcaaaacgctcaccaaattggatcacaagctctacaagcgtctccacaactggcttcatttcagctaagctttttaaatgctgggcaggactgcgcatgaagtattcatcttttagtttttctaattgttttttcgcttgattacgtgcatctgtggctttttctaataaagcagggtcatattcgtcccctttgcacgttttgagccttttaaaattgacgttcggcaaaagctcataaagtttctcaaaatcatcttgatgacggattaattcattgacttgctctaaatcatctataaaattctctgctctcggtgctgggccacccggctcttttgatagcgaaagagctcgttcaagcagctcctgacagctccggagaacgagagaaagatcttctttgatatatggataaaacggtaattcttctacttttgtttgagcatctacatcataaagtgaaagaaatgcccgcatccattgctccggagatggatgagatcttgaaaactcataaattctcttcacgagccattgcaaatctaagtcgtgacggtcagacgtgtaacggtcaaccagttcaaagaatgatggctttccagccttatattcatcctcaaacagttcatctaacacttcatctcctaatagttctccttctgtttgatcggccaaacgaaagcctggatcaagatcaatttcatagtaaaaggtgcgcaaaacctgcaagcaaaaggagtgcaaggttgaaatattggctcgattcatgagggacagctgccttctcatatgaagagacccagggtttttggctaattctttttcaagtgcttctgtgatccgatgcttcatctctgccgcagaagcatttgtgaaagttacaacaagtagacggtccacatcaactggatgttcaggccgggtcatttttcgaatcaggcgttcaaccaaaacagctgttttacctgaccctgccgccgccgcaaccaagatatcttgtccttctgaaacgatggcttcccactggtcatccgtccacgtactgttattcggttttggtatttgcatactgatccccttcttttttgatccggtctatcacaacatcgtccttttcagaggtgagcactctaaaatcattatcttctattgattcatcgaattggcaaatagacttgaaagaacaaaagcggcaaggtgtttgatcctttaatttatatggattaattgtgacctctccatttgtaattctttcgcctgcttcttcaaatgtacgccgaacgtgttgtgtgagtatatggaaatgatcttcacttaaaactgccgaatcagaacggaaagacccatcctttttcaagccagcttgaatgacttgcgatctacctgaatcaagcgtttgatccattagctttactgcttccacatcttcaagcaataaacccttcattttaaatttcttgtatatttcctgctcaatttcatcttctgcaagcggaattggtgcttgaatgagcggatcatgaatatggaaatataaaatgccagcaggcgttgcttctacgccgagccactctttcgaatacgtaatggttaggtctaagtatgtgagcatttgcaaggcaagaccatagtatacttctgctaggtcaagacctttctcactggatttgtaatcgacgattcttaaaagcagcccttttgaaccttctgctttatctaccctgtcaattcttccgacaagttccatcgtgcagccattctttaattgaaaagtaaacggcggcaaaggtccttgccccccgaaacctaactcaagccctactggagaaaatccactcactttggcatgttcacttaatatagaagagactcgaattaagattttctggagcttttctttaatataagcatgccgattagagcttaatagaatttccttttgaagacgcggagcaagctgttcgattgcatgtcttgaataggtgacacaatcttccttcgttaggtttttccaatcctttttttgttcaactagcgtatctgaaatatgcttcaaagccgagtgaaacagctggccgatatcgggtgcttccaatttgtaaaattgtcgatccttaagttttaaaccgtgggaagcaaagtgagaaaatgcacacgcattgaatttctccattcttgaaacactgccctgaatatgatcaccgtaaagctcttttgtgacatttggctttaaaggcttcgctcgatttgtaaagaacaaacttgacatgatgttttttgatacatcccgattaggagatgtcattaagtagttatagacactccaccatacaccgctaatgggatattgattgagccattgctgcagctgtgagacagtatacgacaacgatacatgctcattcgctacaaattttaattgctcattgtcttccagctgttctggatctaatacataaagagcctgctgatgatttggcataagctcttggcaatacttgatgagtgttgaaggcaataaagaacgtccttctgcatcagaagccgcataggatagatacaaatgatgggatggacttgataacgcttggtaaattaaaaattgctcatctagcagccgttcttttcctgtctctgccagctctgctcctgctcgttttaaccattctcggtcatcctcagacaatacactctcatcagaggggcgtgcgggaataacgccatcgtttacaccaatgataaacgtacacttcacttgatacattctggataaatccatacttccgataaatacttgatcgagtgaaggcggaatcaaagcgaattttagagaagctaatcctgtatctatcatctgttggaataaaggaaatgagagctcttcgtcacctagcatgtcaacaaattcatccattaattgaatcacagcatcccatacttgcccgtgctgcattgcttcagctaatcgacctgcttcttcagcctcaagcctcgctttttcaagcttatctggtacttgtatctcttctaaaaagacatagacagcctctaccatgtcccttaccttttgtgcatttttaagtcttttctgcaactggtaaagcgggggcgcgatccattctttgacatcatttagcatttgttccatttcgatttcttgatctgtttgcctgaaatcctcatctaatgattggaagcgcctgtaatgaaaccgggaaccatttgtccagcgctctccttttacaccataagcaatacaatagttttcgagctgatctgcctgctctctcgctttgttcttagtgatttcaagcggaaataagaactctgttttcacgcagcgaaataccgcctcataccgccaatttccttttatgacatccaagctcgaacgaatcaattcaatgagcggatgatactgcatcgattcatttccatcaataaaaaaaggaatgtcgtaatctcgaaaaacctcttttaacgtatctttatagtcgtctacatgccgtgctacaatcgagatatctcggagtctgagtcctttttctctcactaaatcaaggatgtctctcgctactccctcaatttcagctcgtttatttgcacttttagacactgtgagatgaggggtgttttcctgatatggctgtactggccgctgctcatattggtgttctaaataagcaagatctggtgtataaaggtgccgatgatttctttcaaaaatggtttcagaaatgtcagctccgcactctttagcaagctgatagagctggaaatacgttttacctgtcatacgaaataaatcaagttcatttggctgcctatcatgataggatcgatctactgtgaaagccgcagttatttttgcagcatggagcaagagctgttcaatgacaagaagctgctgcggtgtaaattgataaaaaccatcgatataaatgtgtgctccttttatttcttcagctgatggaatttgctgggcaagaagagtcaaatagtcttctgagtgcacatattcatcttgtaaatgctcctccatctgctgataaagaacatggagatcatgcaatttttcggctgcccgtctttcttctgtatactctgaatgcatgctctccactgaaattttctcaatatcctcaggcagcatacagtatcttttaaattcagccatcgttttttcgatttgctccacaaaccctggcttatcactggcttttttgaatactttaaacttgtctttctgctcttcaatcacttttcttaaaagcatttgaattcctgtgcttgtcacaaattgccggttcgctccaccagtctgctgtaaaatagaccaagcaagacgagtaaaactaaaaactttagctctgatcattccaccggcttcagacgttttcgcaagctcatattccattaaaaatgtcatttgatccgggactaaaaaaatgattggcggacccaacggatcaagccgaagctgttctttgatttcctctaagattgcagtcgtttttccactccccgatctgcctgctaaaaactgaatctccacgttccacaacacctttcttatgtactcatattctagcgaaaataaaggtaaatagctattttccgatcacgttcccattctcctttctgaaaaaaacataggcacctttcctcactcttttcatatcataaaccatcatgaacataaaggaggctggcaatatcatgtattacggttactatgactactcgccttatgacatgcgccaaaacacaagaatcatttcagaccttgagaaggcgatcaatggtgaatattctgcgatccagtgctacgaaaaacttgcccaaaaagcaaaaaatcctgaagcaaaaaagatcattcaagaaatacgtcaggatgaagtcagacactatcaactattttcaaaactatattattctttaacaggtaaaaatcacaaaccaagcgtaacagaaccttgtccagaccaattcagagaagggcttctgtttgcctttaaagatgaacaaaaaacggttgatttttacttaagcgtatcagactatgtccgagatcaaggaacaaaagagctaatgaaacgtatcgctcaagatgagcagcagcacgctgtatggtttttatatcttttaacgcaccatgtatcatagatagtcctattttaataggagagcgtatgttccgtcaaaagatgaaatcgatatttcgttcattcaaactgtcaaagaaagcgttaaatgtagcaaagcctcccatcccttcctcattttcaaacgagaaaatgagaattcgatcataaaaaaaactcctctgccacaaagagcagaaggagtttttatgatcttttaatgaaattttgcttcattgctttgctgctgatgcttgagaatcccatcaattgatagcagcttactgccgctgagagttaaataaagcgccatgacgagaagcgaaagttcaaattcataaccacctacaaatcctctagaaaaaccaacagtgataattgctactgccataattggtacaaataatgctgcgataactcgagttcctagacctaaaatcaaggcgataccaccgaccagctcaattgtcttcacaatataagccataaattcaggtacaccgatttgcccgaagaatgctgctgtacctcccagccctccttgatatgcctgaagcccatgtaaaaagaaaataatccctaaaataacgcgtacaaaaagtgttcctatttcttgatttgttttcatatagtgatttcctcctgtttttacactacacaatgtaatgttaataagtaaaaaaattagtaattaaggttgagcattatcatcaagatcaccatcagaatggctgaagtgacgattggaatcattggtacattaaaaggaatattgtaagttggatttaaaattttttgtattcttaaattcaatgcccgatccccaaaggacaccgcaaactttgtttgtttttgaaactgggttctttttttaaccagtttcaaaagggcctgccctactccaagctcagtgcctgtcttctgaatggcatagtcatctgcaatcacttcacgaaaaacagagtagctttgtctcatatgctttaacactggaatgtaccaaatgacttttgtgagcattgagaacataaaagccttcaaaggatcatagctgtatttgtgatgcaattcatgatgaactacagcgtcaatctcttcttcatccagcatgtccatgagagctgttgataaataaacctttgggtgaagcatccccattgcaaaagcaagcggttcatgacaatgaaatacaatgatatcgttttgatatttctctgacagagattcggttgacggttgttcgactgcgagcatcatatgtcgtttgaattgaatgtactttctgatttgctgtgccatatagaaaatcgcaaaacccaatgtggaaaggactaaggcatccagaaagtattttaaaggagtgaatccatagaattcgagcacagactggcatacatgaatcagattatatgcttgattccagccaaaaaagcttgaaagcacataataccccatctgataaaaaatcgttagaccaatcaatataccgcctaaaaacagcagactcgacttcattttattcattttgctgctcctcttttttagacgctagccttgcttcaagcactttgagcaattcagggtcagcactttcaattgcatccaccatatgattcactgccagcggaccgaaatcgtccatcaatccttgtgtaatccattttgtttgctcatttagaaattcttcttttgttaaaataggattataaatagatgagcgcccttttgtttttttctccacaattcccttttcggttaagcggttcagcacagtcatcactgtgttgaaattaatcggcttctcatctgacagcttttgctgcacctctttaatcggcatatcctcaccatcataaaggatctccataattctcccctctaaaggaccaaaaaagcgattcaatcccttttcattatatttaaaagaaggaattttcatgttatcacctcacactaagtagtgtagtgtaattgaaaatgatagtcaactgataacaaaaataggggaaaatcgttgtatattgactttgtttttggtaaaaattatatctttctttataaaaatgtactaatcatttagtgataagataatcttatgtaaatggtgaaaaaattcgtattttatttatagagacttttgtattatagtgaagttaacaacatttcacttactgaacaaacatataggaagaaggtttacatgtaatgaaacaaggccttcgaaccgatctcattctcattgcgacaagcggtttaggtggatttcttttgtctttaacaggtatgtctattggctggatggtaggtacattaatcaccgcagcttttattgcgatgcgccgccccaccctgtttcagcgtaaaggaaccagcaccttacgtattcacagcagatggctgctccttggtcaattcattctcggaattgaactcggacagaaaatgaatatgaaggtccttcacattttcgctgaaaattggctccctgtgagtttcatgctcgtcttttctattctactggcgatgctctcaggctttgtcttatggaagctgagcaaaaccgatatgctgacaagctttgttggaactgcccccggcggtttatccgctatgccggggattgcccaagaggtgggagccaatacagctgttgtgagtctcgtgcaaacgatacgtgtattaatggttgtactcactatcccctttacagtgttttatttgaatacaaaaaaccaagcggatgcggctgtagttacgcaagggagcgctttttcttcgggcgttttcaccctttcaaacatctcttggaccgctgcgcttattttaggtgcctggctcatgtcacgcctagcagttcgtcttcattttcctgccccttggctgatcggcagtatgctaggcgtcgcagctcttcaagttggtgcgggcgcgctcataggttatgatttgattccttattggccggcacaagcgaacattgcgtctcaagtatttctaggtgcaaccatcggttcaaaaatgaataaacagatgtttgtcgggctaaaaaacactctcattgtggctgtcgtcagctcagctggactaattgctgcaactgtcctcagctctattgccatcgctgagatcacaggtatttctgtcattacagccattcttgctttttcgcctggcggtattgcagagatggcaacaacagcagtcacactgcacgaggattctacctttgttgtggctgtacaagtcgtcagaattattctcgtcattgcaatgctgccaccgtttttccggttcttacatcatgtatgggcaaaaaggcagcctgattataaagccgcaaaataaaaaagagacgctttgcatatgcagagcgcctttttttattcgctggtattccttttgacaccgacaacttgatcctttgaaatggtgccaaaatgccggctgtcgaagctatgtattcggttatctccaaccacaaagtaatgattatttttgattttatcgtctcctgtgatggctttcagctgaaaatcccctgttaggacgttccccattttatgttgtttctgctcttttaaataaggttccttctttttttcaccatcgacaaataactgatcatcttcatacttgatcgtttctcctgggagtccaatgacccgcttgatcaagatttgatttttaggtccgtgaaataatacataatcaaaccggctaattttcgtgagttttggcgagaacttattgattaataattctgttccatctgtaaaagttgggtccatactagccccttctactttgtatgtgacaaacatgaaattctttacttggaacaataagacgatgcctgtaataatcatcaaccatagcaatggcttctttttcattaagagcctcctttgtcctcacgtttactcattcgaatgtttaacctattttctactctctttccaacataccataatactgcaataactagaaccgcaaaaacacttcttaacggattcttaactaaagcagagagatcatacccaataaaactaatgataaaaagcatgacacacttgccagttaaagtagctaatgaaaattgccaaaaactaattcttgataaacctgctacaacattgacggcagcagagggtgtgaaaggaaagcaaagtaaaataaataatggaccaaatccccgcttctccacccaaagcattaatttcttaatggaaggatgcctactaataaagttgagcattctcatccgtccaaattttctgatcagcaaaaagacaagaatagaccctgcacttgcgccaatccaggtcaataaaaagccttcccacaggccgaatgcatttgcattcgctatagcaaacgcaacgagtggtaaaaacggaagaaatgcttctattaaagggagcaatatggcgacaatcggtccaaaggccttgtagctctcaaaaaatgatgtgatattttcgtgagtaaatagggaaagaaatgatgtcaacttgtttgactccttcaaggtttgtctacttttcattttacatggaaaacataaaaatatacaaatgaatccccccccttgagattatttgactcattcgatataataaacaagaacgtgtgttctattaagaaagaaagcaggcttggacatgacgagactatcaagaatacagcttcagatgatggaacaggccatctttcttccaatggtcgtctccatcctcaatcgtgatttgactcacttaaaacaacatcaaacatttaaactaaatgaaccatacattcagctagtgacctccaccttaaaggaagcacagaaagcactttatgaactaaagcagcatttacgtaaagaaaaaatgaaggtacagcaaattgaacacgatgaaggatttacaacgtatctatttatcatggatggctatgaagaaaaacataaatactttaatccacgtatacgtcaccgggtagaggaactgctgactcggtattttcttcatcaagcgaattgaatttgcttcattgtcgcgcttctccattcaaagcaaaaagcctgcctcagcggcaggctcctacatattatgataattcaagctgttctctcagctctgttctcacttcttctaatccagcgccatctaactcaaagtaatacacattcccaggctgataatcatggccctttagctgaatggtatccactgatttcaatgagctcaataacgggaaaaggccgataaactgcttcatggacagattggttgaaacattatcaccaagtgtatcaatgatattgtcataggatgggatcgaagaaatggatttagacttttcaaagatggcttgaagtgcttccatttggcgcttcccgcgcatgaggtcactatctgcctttctcgttcttacaaacgctaatgcttcttcaccgtttaacgtatgtgttcctgtttgcacatgaactttcccttttgagtccttttccatttgttttgcgataccttcatcttcaatcgtgacgtcaattccgtttagctcatctacaatgtcttgaaacgccttaaagttccctgaaatcacatagtctacagggatgttcagcaaattttcgaccgttttgactgacaaatctgcacttccaaacgcatgggcgtgggcgattttatcgtatcctcttcctggtatatcaacataagaatcacgaggaatactaaggagcttaatggttttctctgtccggttcaccgccgccagtaagaccgcatcacttcgtgcttcgtctaccgtttcacctggacggctgtcaattccaagcaagagcaccgagaagctgtcctttcctggatcaaaagcttttacacgcttttgcgaggtgtctcctctttctaatgacacttgcgccttatctgacgcttttgaaattttatagtaggcatatcctgtgacggatactgccatcaccatgacaaaagccatgataaacagcactgctttcacccaaggtctcagccttcttttggatcttgtttttgctctagttttttccttcatcctttccgaaccctcactctatcttagtctatcaatgtaggttccactataacatattttgatgaaagtttcctacacgcaacttatttttatgaacccacaattaaaaacttgtaaaactcagataacccatgcttttctgctagtagtgttctttttaaatgattccgtttcgcattgtctatccatatcatcgcaggtgagaatcagaaaaaaagcaacctctaatgtcggctgctttttcaccattattgaatgttcacttgaaattgtcccttcaattcctcttctgcttcttgaaataactgctttacgctttctgcatactcgccaagagcgtccttgctcatgtcaaaattcacccatgtcagctctactggcagatttacttctcctgtcaaacagtcccatagggcatcaagatttttcccgtagtagtcaggaaggtgtaaaactgtttttagttggtcatgaagctcttcttgcgacctgcacgatgcaccgtccagctgcacttttttcatgtcatcttcccctctcatgcctttattttaaacgaatggaaggaaaaagagaaagcaagactcctcacttttgtttcttgacacttgagatcaaaaggatgagacaagctgccaaaacgaccaagaaaaagacggtcaacaccatctgggttccgtacaaatcagcaaaaagtccgacaaaaacacttggaagacccagacctaaataggcaaataaataaaaccctgcaacggctctagctgcttccttttttccccgctcgacaatcagctgaagaccacctaaataagtaaatccatagcaggctgtacccgcaagcatcgttccggcaagcacaaggatgatggatccgctatttgctccaattagcaagaggccgtatccgcatggaagacaaataaacccggcgaggagcgctgctgtactattcattttgcgaacaaaaggctgcatcaggacacctgccatattaattaaaaatagtgccggccctacccataattcatatccatttaatttaagctgtgctggcaaaaccgaaatcacaaggccgcacaccgaccacgcgacagcaatcgctgcattcgctggcattgttccttttggaaatgttggcatgttcatcatcggtttacctgaatctccttgtacaggcggaacgaaaaagaagacacccacaatcgttaggattaaaaagcccagcacaatccaatagctaagcggcgcaagcgtcatatgctgaaaagaaagaagtgccgtaaaaagagcaccgcccccaaaaccaaccgaactgcataacgcaataaacgttggaatccagtttgacttttctggatataaagcaatcaaataagcggtgcatgtgccaacactcaggccaagccccaccccttgtagcagccgggccaaaaagagcatctgaatggtaggatgtacgatcatcaataaggtagcacataatgaaaaactaagtgcgaccaataaaaccggtttacgtccagcccggtcagatatccccccaagaaaaagcaagactggaatcagtccgaagacatatgcagcaaatacaagggctgtcgccgcttttccgtaccctgcttgttcggcatacaacgtataaaggggcacctgcagatttactgcggttgtaatcataaaaagaccaaataaaacgaatgtaaatggaatgatagataggtgtgtagtgtcttctttagatgcagggatcattttactctctcctttagtcataagcatatgagaacagtgtacacaccttttggcttacttcctatatccaaaaatgacgctattgaccactccatatttccgtgtcatcatcatgttatatgtgacaatgagagaaggtgtccgatgtatatttatttagaccgctcaagtacgaccccgctctggcagcaaatcgtgactgggatcattcaacaaattcattccaaaaaactgaatcctcatgatcagttaacaccgacacgcgtattagcacaggagctcaatgtatcaagatcaacaatacagcttgcttatgatgaactgctggcaagaggttatgtcagcacatctagacgaggcggtacgaaggtcatttcgagtgatcactatgcggcctccgccccccatcaaggtgagcctccttttcctcttccggtaagaccacactttgaagaggcggagaaacaaatgaaccactggctgtcggccaatcaatttcatgaaaagcttgatattgattttcgtcatcaggaaccagccatcgacgaacatttccaaaacatatggaaacgctcgctcatgaaagcattacagcgattagagatgaaagattggggctattcctccccgcatggtttatgggaagtacgttcagaaatacgccaatacttatctgtagaacgaggtattgatgtagaagaggatcaaatcgtgttaacaggaggcacgcagcaagccattgatttgatttcacaggtattacttaaaaaaggcgatacagtagctgttgaagatccaggctttcctggagcaaggctttcatttatgcatcgtgaaatgaacatttatcccgcgcccgtcgatgaagaaggaatgatggtgaatacattaccacaaagaacaaagctgattgcagtgacaccctcccatcagcgtccaaccggtgtatgtatgagtgtgagcagaaggcagcagctgctaaaatttgctgtcagccatcagtcttatatactagaggatgattttgatggagattatcgttatcatggcggaccgcttccttccttattttcagaagcatcaggccatgtgatttatatcttaagcttctccaaagtgctggcacccggcatccgccttgctgccattatcggctccaaagccgtcataaaagaaatcgcttccttgcaatcactcattcaaagacagctgcccattatggaacagatcacactcgcctcttttttcagagaaggagacttcacgagatatgtcaggcgaatgagacagctatataaaaaaagacaggctaccatgatggatgcccttttaacacaacaatttgacaagcactttcatatttatggaacagatacgggtcttcatgtctttttagaaggagcaccagactttgacgaaaaaggcagtattgaggcagcaaaagcagcaggtattggcatttatccattaagtccttattgttttgagagcaatcgaaagggattactgctaggcttcgcctgtacggacgaaaacatgatccaagaaggtgtgcgccgcttaaagcaaatactttatatgtaaaaaagcttggaagtccgccttccaagcttttttacgttgattgctgaatacggccgacttcttcaataaatgcagctgccctctgcaatccatcttgcagatgatgagtagcggaaataaacagcttttcttgatctgggcgctttaatagctgctccacctgacccattcctttttcaaatgaatgaagacctgtctttaactgttcatctgcctcttgataagcggctggaacttcttgatgagcaagccccttttgaatcacatgatcaaaggctttcgtcgcctttttcaattttttatttacttggatctttccctgtccatctgaaataaattggtcggtcatgttctcataagcttcatttaactcatccatataacgctgaacccattgttcatacgcaacttcttttgtgtcttgttttgaaggcgattgacctgcttgctggcaggctgctagtaaggtcactgtcaaagtgaacagcagtatcaattgcgattgttttttcatacagagcctccatttcctattcccattcgttcatatcggttaaaataggaggatcctttaccacatacgaacactttacaagaaatgatttcttttattgtaacagacggctcgtgtcacttctttgatttatgagtaattgcttgaaaatacgtctaaggatccacattcccctgtcatttatttggtggacagtctaccgatacactctttagacgactggatatatggatttggtttcaacaaattcatggtcatggtggatgttttcgtgtcatcatgatgatgcctcatcaaagtcgctttgtcctgttgatttattgaagtttacctttacaagcaatttcaagctcttcgactacttcaccatcttggatgagataggctttttcatggagattgacagcaggacaaatatgatttggaatgatttgcaccttctcaccgatctggacagtctgacggaagccttcgtgataaatgatggcatgctcatcaaatacactggaaacaaatacatcatcatagccttttactttgcctagtccttttgtttgtgtcagcccttttgtacgggtttgagccgtgagccctttggctccaacatctgtaatgacacgagtctttgttggcttactaatgactgtcgtcaggacggctgctgcgcaatatgaaaaagtgccgatcacattggactgagaggcatccatgaaaatgtaagtaccaggtctgatttcggtgactccctttggaatatcaaattgaaataagaacggcggcgttgatcctatgctcaccacctctagcagcatacctgcttcttttgcaatctgtgcaaaccgaagcgttcgattcacagcgtcttcatataatgtctgacaatgcgctttactttccgccttgtatgtgtgaccatcatgagaaaaaatcccttttaaatgaacgaagtcacatgtttttatcgcctgcaagatttgatggaaatcactctcttcaatgacaccagacctctcttctccaacttctatctcaattaaaacctccgcttttttctctgctccacgaaagacctcttcaatttgatgcacatgctctacacaatctattccaaatgaaatgtgtatcgactctgccagctttcgaattcgcttcagctttatctcacctacaatttgattggcgataaagatatctgtcagcccatgcgctgccatcacttccgcttcccctactttcgctacagttaagccagatgcgcccatctcctcctgcaccttcgcaagactaggtgttttatgtgttttcgtatgaggacgcagtttgacctgctgacggtccgcatattgctgcatagccgctagattctccatcatcacctgtttatcaattaatagcgctggtgtatctagttcatcataagtcatcatcatatccccttctctactgctcattatataaaattttatacattatacttaaattatataatttattatacaattatcaatgcttttttctccgagaaagtaagacgatatgctaaacataaggagcccagcggctgaactgccgctggttttagttaatatctgttccgtagctcccttaatataaaatcgtatacaaggttgagctgttgttcctttggatacagcataaattcttgttttttaggaagaccaccatcaaggcgatcttgaaatttcgttcggagatacgctgttctgtgtacctgactctcaaaagatttatatgagacatcgagtttgacggtttgctcatttgtaaagatgaccaccgtgtctccgagggatgattcctggaaggtatgaatgtatttgtgggagatccagccgcactgaggacggttggatgaataggttgggaagaaatacagatgattggatgagtcaattacaatgggaggcttatgagatattcctgttacttcatatgttcccgcttttctgcctgcatagcttgagccaaagaatctgcagctgcgttcaataatttgcaggggctttaattcaacgtaaaagcttgtctctctttctatgacttttgaatatactctttttccttcttcaactggaaggaccgccattgttgtttgattaatgacgtatgaatctaaaggtgtttcactaattcctgacacttcatttcctcctgtgttaatttttggttattttagatactattaatctatcaccaacatataagaaacgacaggattttttcaaaatttattaaaaatcatttttttatcgtattatttagttcatttgatctatcgaaaagccttttttaaagttatatcacatcgtgtcgatcggacaagaggtgtcgattccgctcaaaaataaattgtctaaaaattataaattcttgttgattttttctccaccaatccatatactataaaaaaggcatcggggggattctttatgaaagagaaaaaaacgtatgctgagctcatgaagtcccgcaacacccaaaaaaccgaagaaaacggcgtgacgattttagacatctatattcaaatggttttagatgaggcgctttataaacagcgcttaaccttccttagagaagagattgataaggcactggatcagcgtgatgaaaagcgattcaacgacctgtcagctcaatatgcagaacactgcctacactaatcatgatgattttacttgcggcaaagagacagcaactcgtctctttaccgcaagttttttgtttatccatttaaaatggttcctccatttacatgcagaatttgtccatttatataagaggagtcttcgctcgctaaaaataaatagctcggcgcaagctctactggctcacctggccgctccattggaacatctccgccaaattcggagacttccttttccgtaaaggtcgatggaatgagtggtgtccaaatgggccctggggctaccccatttactctgattccctgtttaataagcgataaagataatgatctcgtaaatgtcacaactgccccttttgtagctgaatagtcgatcaaggtttcatgccctttataggctgtgacagatgcggtatttatgatactgcttcctttctttaaatgaggaagtaccgcttttgttaaataaaacatggcaaaaatattcgtttgaaatgttcgaagaagctgatgcgaggtaatctgttcaatgcttttttgcggatgctgttccccggcattgttcaccaaaatatcaatggaaccgaaagcatccttcgtttttttgacgacctcatttgaaaacgcctcatctcctaaatcacctgcaattaaaatagcgcggcctcccgccttttcaatatagtccttcgtttcctctgcatcgcggtgctcactcaagtaaacaatggcgacattggcgccttccttcgcaaataaaaccgagactgctcttccaatcccgctgtccccacctgtcactatggctgttttccctgctaattttttattcggcacctctcgatcaaaaacaggtcttggattcattttatattcaagacctggacgctcactttgatgctgaggcggcaatgttttcttcggctgctttgttgacacgtctgtccactccttccttttatcttgtttatttttatgtgttggctatttttttatgtatgtcgaactagtttcctttcgaatgtatgtttttcttcatcgaggaaaaattatacacaacaagtgactaactggaggcgataatatggaacaagaacataaggggttggaacaggcaaaatcgttatggattgcggatagtcaaaagcattcttttcctgcagtacatgaggatctcacagcagatgtcatcattgtcggcggcggtattaccggtatcgctaccgcgtttgaaatgacagaacgcgggctggatgtcatcatcattgatgctgatcaactgctgcaaggtacgaccggacatacgacagctaagattacctcacagcacgatgtatactaccatgagctgatccagcaaattggaatgcccaaagcccgtttgtatgtagaagcaaatgagaaagcaaaagagctgattcaagcacgcgttcaaaagtacgacattgattgtcagctagaagtcaaggatgcatacctctatacaaaggaagaaaacggtgtcaaaaaattaaaaaaggaattagatgcctacaaacagcttgggattgatcgggaatggaaaacagcgcttccttttgatgctgacatcaaggctgccctagcaatgacgcagcaggcacagttccatccccttcattatctcaatgcgctcattgaccagctcctagagcgaggtgtacgtatttatgaacagacaactgctgttgacgtgaacgaaggaaaccgccctgctgtcgtcaccaaaaacggccatcatctgactgggcgctatatcatttcctgttcgcactttcctttttatgatggaaagggactttatttcacgcgcattcacccagagcaatcctatgtggtagcagccaaaacaacgaagccgctcccagatggaatgtacttagggatcgaccagcctgctcattctttaagaacagcagaatgggagggtgaggaagtggtgctcatcggaggagaaggtcataaaactggacaaggcggggatgaatctgctcactatgaaggattagaaagttttggagacgccacccttggaattgaagaggtgctgtatcgctggtcgacacacgatatggtgacaatggatcaaatcccttacatcggccgcctgaccaaacaccatcaaaatatctttgttgcgaccggttttagaaaatggggcatgacaacaagccatgtcgcagctactcttatcggggatttgattgaaggaaaatcaaatccatccgaatccatttttacgccatcaaggcctgtttctgattctttcgtcaaagatttcgttaaagaaaacagcaatgtcgcagccaagctgatcagtggtaaattaaaacgaaccgatcaaaccattgatgatttaaagccaggtgaaggcggcattgtctcttatgaacataaaaaatgcggtgcctttaaatcagaggacgggaacatttttcttgtcgatacaacgtgtactcacctaggctgtgaagtcgcttggaataatagcgatcgcacgtgggattgcccgtgtcacggctctcgtttttctattactggagaagtagtagaaggcccagcaaagaaaccactaaaaaggtcatataaagaacagtaaaattttactgattccctttaaaaaatccaatattatccgatagataatataaagtctgataatttgtgatgattatagggggacaaaaacattgttatttaaaaaagagaagaaaagaaaaaacactgcttttttcacacagcaggacgatggaataaaacgtatcaacttttctgacaatacggatatcgcaaaacaaatcaagatgatagatctgacgcagcatgacctattgattctaaaacagctcaatccaattgttcaggacgatatcgcacatatcgttgataaattttataaaaatttagaagttgagtcttccttgatgcatatcattcaggataatagttctgtcgagcgtctgaaaaaaacactccgcattcatattagtgaaatgtttgcaggtgtggttgatgaagcctatgtggcaaaacgaattaaaattgcgcaagttcatttacggattggccttcagcctaagtggtatatggcagcattccaggatcttctgctatcgattatggatttatttgctcagcatatccaagatttcaaagaatatcagacagcagtgaaagcgacgacgaaaattttaaatttagaacagcagcttgtccttgatacgttccaaaatgaatattctaaaattcgtgatgaagcagaacagcagcagcaggagctccatacaaagatcacagaaacatcaaattcacttgcttctctcttctctaacacaacaaatgcagtggacaagcttgtatcaaaatctgatgagatggcagacatgtcacaagctggaacgcaaatttcagcacaggttgaggaaaaatcgatcggcggtaaaaaagaattagaaattcaacaaacacaaatgaaccaaattgatggcagcatgacaaagattgaaacagaaattaagcgtttagaagaaatcgcaaaacagattgaacaaatctttgggattgtcacaggcattgcagagcagacgaacttgttatctttaaatgcctccatcgaatctgcacgagcaggcgaacacggaaaaggctttgctgtcgtcgcaaacgaggttcgtaaattatcagaagacacaaagaaaacggtgtcaaccgtatctgaacttgtcaacaataccaattcacaaatctccattgtgtctcagcacatcggagacgtgaatttactcgtgacagatagtaaagaaaaaatgactcaaatcaattcgctcttcgatgatatcgtcagcagcatgaacttaagcaaaaatcaaaatggaaaaattgaaatagatcttcaaaccttcctaaacgaactgaaggaagtcaaacaaacggtgtctcaagttgccagctcagtcgaatccttaacaagtctcacaaatcgctaatccagtcttttttcttctgctttagtataatagaagaaaagatagaaaaggcgggatttgattgacaacaatttgcctagtcagacacggggaaacagattggaatgcagcgaaacgaattcaaggacgaacagatatccctttaaatgatactggtaaatggcaggctgaacaaacgggcctttatttaaaagatgcccattgggatgttgtcatttccagtccacttacaagggcaaaagaaacagcacatttgattttaaaacatgtagatgcgcctcttgtcatcatggatgatttcattgaacgtgattatggcgatgctgaaggcatgtcatttgaggagcgccaaaagctgtttccaaataaacagtatccaaatatggagccgcttgagacaatccaagatcgaatggtagaaggcattgagaaagtcagagcagcctatccgaatcaacaagtcctaatcgtggcacacggcgctgccatccatgctttactcaccaccttagcggatgaacatcttggtcttgagaacacgagactcgtcaatgcttgcttaaattatgtggaatggaaagatggtaaatggaaggtgcttgattacaatgtggtcagccatttaactcaatcctctcctacttaaagaacctgttatgtaaacaggttctttttaaatgacaaaaacaatgataaaataatatttttttatatcgaaattcgaaatagatgctagacgtttctacctattttaaggcttttcgtgtatcgaatatttctccagaaatggatcataagaaaaaaagcacacttcctttttaatagataaccgctgaaatagtagaataaacatattttaccatcatttccaagtgacttaattccccaattttcgctaggactttcacaaaaattcaggtctactcttatttgcctacttccattaaactgaatatacagaatagtcaaacggatcattcttatagactacggatgattattctgaaataaaaaaaagggatgtggattgtgcgtgaaaaagaaaaatgtgatgacaagtgttttattggctgtccctcttttgttttcagcagggtttggaggctccatggcaaatgccgagacggtctcaaagtcagatagtgaaaagagctatattgttggctttaaagcctccgccaccacaaacagctctaagaaacaagccgtcactcaaaatggtggaaaactagaaaagcaatatcgtctcattaatgccgcacaagtaaaaatgtccgaacaagccgcgaaaaaacttgaacatgaccctagcattgcttacgtagaagaagaccacaaagcagaagcatatgcacaaaccgtcccttatggaatccctcaaatcaaagctcccgctgtacacgctcaaggttataaaggtgctaatgtcaaagtagctgtccttgatacgggcatccacgctgcacaccctgacttaaatgttgcaggcggtgccagcttcgtcccttcagaaccaaatgccacccaagactttcaatcacatggaactcacgtagccggaacgatcgctgcccttgataacacaattggtgttcttggggtcgctccaagtgcttccctatatgctgttaaagtattagaccgctatggcgacggacaatatagctggatcattagcggtattgaatgggcagtagccaataatatggatgtcatcaacatgagcttaggcggaccaaacggttcaacagcgcttaaaaatgccgttgatacagcgaataatcgcggagtcgttgttgtggcggctgcaggtaactcaggttccactggttctacaagtacagttggctatccagcaaaatatgattctaccattgccgttgccaatgtaaacagcagcaatgtcagaaatacgtcttccagcgcaggtcctgaattagatgtttctgcacctggtacttctattttaagtactgtaccaagcagtggatacacttcctatactggaacgtctatggcgtctcctcatgtagcaggagcagcagcgcttatcctttctaagtacccgaacctatcaacttctcaggttcgtcagcgcttagaaaacacagcaacaccgcttggtaactccttctattacggaaaagggttaatcaacgttcaagcggcttctaactaaaaaagaataaataaaatccggctgatgcagccggattttatttattgcttcctcgatgtttcctctttttccgctgctttttccatctccataattctctccatcatcgttgggtgcccgtagcggaagaccttcactaaaagtggtggattcacctgagacagtcctgattttgcaagcttttgaaaagacgtcacccctgcctctccgtctttagtcaggtttatcgcatactcatctgctgcacgttcttgatgtcttgaaactgcatttgtaaaaggtgatgctgcaaatgacagcatcgatacaatcatgagaagaagcggaagagcggcgatatcgcgcggctccctcagccgaaatagaactgctcctttgcgatagaaataaaaatagagacggtcgattgcaaaaaatcccgcaagcgacagtactaaatatcctgctaatcctatatagacatgcttcatgacgtaatgtcccatttcatgcgccataataaataaaatttcgcgatctttcagcttttgcagtgtcgtatcccataacacaatacgcttattttcaccaatccctgtgacataagcattcatcgtgttcgttttctgtgacatattgacctcatatacatgatctgccgggatatgagctttgtctgcaagcgttaagatcttgttctcaagagcttgatcctttagtggataaaaactgttatataacggatcaataacgactggctgtataaagaagagaaatagtgtgaatgggactgtcagacaccaagcatacagccaccagcgctttcttcttttttgaataagccaaaagaatataattgcacatagggcaagaagcggatattgaatccagaaatctagaatttgatctttcaaccagcttgccgtactttgagcagatactccgtagtgcaaagacagctgatagccgatccacttaatgggaagcgcaatcagcattgtcaacagcgacaatacaaacacatatacaagtttgcttaaaaatgtaaaacgagctgctgccagactccagtctgctaattttcgtgaaaaccctgaaatgagcagaagaaaaaagacataccaatctaatggaattgtcatgaaaaacagcaagttacgtatgttcgagaaattctcgctgatgacaagctcatggcttgtcataaatgtttgcggatctgcacttgttccttttacactgtcaggaaccgatgcatccccaaatagaaacaaataagaataaataaaaagaccgtacaatatgtatgctaccgttgcaagagctacccatttacgtcctcgcacaggtcagcctcctttccatcactttctctattctaagcatccattcttttgtttagaacctgtctcatgtggctccatcatagcatgccctatctgaaaaagctttcacgaaaaaaatgattatgctactcaaaaatcggagatgctacatataaaatagtgagttggaggatcgaaatgaagaaaatccttgcaggagttatgatctttggacttttacttattaccttcttttatgtattcagccggacgagcgacatctttgatgagaatcgagctgaaaaattgctcctttcatctgaaaacgagtccatttcttatgaaatagatgataaggacacagcagaagatttaatagaagaattaaacaaaggcaaacaaacaagcaatcatctcaaaaaaaatttaaagaaaccagattatatcgccaaggtgatgtacggccgaacaaacggcaccacctttcagctttggacaaaccgttcgcaggttgtttttttagtagatgggacttattatgagctgaatcaaaaacagtctcattcttttcagaaacagttaaaagaagccattcaaaagagctgaaattttatctctttgtcttctgaacagtgttatagaacctgtacacactaagggagtctcttcataagagagactccctttttttatttactttcctctgcttgatacttttcctttagtgctcttcttaaaattttacctgttgtgttctttggaatatcatctatgaaatggatcgtttggggctgcttatatttcgctaaaaagcgtgaacaatgtgtgatgatgtcttcttgatcgatgtgagcatgtttcttaggggaaatgtaacagacgacagcctctccggtgttcggatccggcacaccgatgacaacggcttctgctacagcttcatgttgataaagcacttcttctacttctcttggatacacattataaccgccaacgagaatcatatcctttttccgatcgacaatataaatgtatccttcttcatctcttcttgctaaatcaccggtgtacagccacccgtctctaagtgcagcttcagtatcttctggcatttgataatagcctttcataatgttgggtccttttgctatgagctctccgacttcatttggaccgacttcttctcctagttcattcacaatcttattcttcacattcataatgtcggtcccgactgaaccgggttttctctttccatcaagagggttgaatgcagtgactggggaagcttctgataatccgtaaccctccagcaccgtgacaccaaattttttctcaaaaccgtaaagtaaagcaataggcattgaggcaccgcctgatatacaaattctcacagaggacatcgctttttcatgcccttcctggcggtataaatagttatacatagtcggaacaccaacaaataacgtgggcttctctttttccatcattcgcaaaagctctgatgggctgaaatgcggcaggacatagatggtcgcgccatgaatcaatggcgcattcatacaaaccgttaaacaaaatacgtggaacatcggcaatgcggcaatcaccttgtccttttcatcaatggataggtactcagcaacgtctctagcatttgaatacaggttgaaatgagtcagcatcgcaccctttggttttcctgtcgtgccagatgtaaataaaataactgccgtatcatcctgatgaatagaaggatgcacggtctctttcgcatggccagacacaagctttccaaagaagacaagttgatctgatacttccttaaaacttgatctgcacgcagattcattttctgcacaaataatcacccgttcaatagacggaagctgttcgtacacctgctcgtacactggcagtagctgttcaggtgcaacaatgccttttacatcacctgtaatcagcatatagccaatttcactaggcgtgtatgttggattgattggtactacgacaagccctgcctttaaagcaccaaaaaaagaaatgacaaaatgcggtgaatttcctaaaataagcgcgatatgatccccggcttgaaacccttcgctcactaaaccatctgcaaagcgctcgatacttgtcatgagctctcggtaggtccactgatttccttcaaagatcagtgcgatatcttctcctttcgtcatcgccgtctgctctagatttttgatcaaatccattctcccaccccttacatgtcatcaatgaatgaataaccattcattttatggccaaacattcctcctttctattataatagacaattgaaaaaatccacaagatcaaatgtaaatcgctttcatttctttcaatcaaaaaagcaccgctatctctagctgtgcttgtccctcttaataaatcaaatcaagaaaatcctcttttgatacgttgccgaagtagtggcgcatgtccatatcctctaatacgtcgctgatcgttttgcgatcatactgctgcccaatgagtcttttttcaatatcagcaatatcccctacaccaaagaaatcaccaaagatcttgcaatcctggatcattccttttttcacttctaatcgaaggtcaatggagcctgctgagaatctcttagaatgctgcaaattaaatttcggcgaacggccgtagttccattcccatttttgatatcgatcaagagaaatctcgtgaatcttttcccaatccttctcagtcaactgatattgagggacatccccattcgtgtcgaaaatgtagcttaacagaatttttctaaattcttctgttgtcatcttttgatccattagttcactaatattggcaaccctgcttctaatggatttaatgccttttgattcaatcttttcttttttcacatttaaagccgaaacaacatgttcaatttctgaatcaaataggagcgtgccatggctgaaaatgcgccctcttgtagcaaactgagcatttccagaaattttccgaccatctgccatgatgtcatttctgccacttaattcagctttgacgcctagcttttcaagcgcctggatgactggctccgtaaactttttaaaattatggaagctgtccccatcgtcttttgtgataaagctgaagtttaagtttcctttgtcatggtaaactgcgccaccaccggacaggcggcggacaactttgatgccgttgtcttcgacatactttgtgttgatttcttctattgtattttggttctttccaatgataatcgacggctggttaatatagaacagcaagtacgtttcttctgggtctaaatattttaagcaatattcttcaattgccaaattaatcattggatcataatgttgttcgttatcgataaacagcatctctctatcttccttccttgttccatctaagccctgaatgggcaagctgtatattgccagtatataacgcctgtgcttcattgactaggtctttatgacggccaaaatggggcaggtgggtgataatcagttccccaacatttgcttccattgcaagcttgcccacctctgtactattcatatgtcctgcacccgatccgtcctgtccagcgtagaagttgctttcagcaattagtagatctgcatccttgctaaatgggacaaatgcctcctgataacttgagtctgctgtatacaccaccacagcatcctctttctgaattctcatcgcatagcattctgccggatgaaccgttttcaaaaaatcaatttgaaatggaccaatttgaataccctcttctggctgataagcctttgccttagtatgtacgtcatccgcaagccgcccaaatgcttcttgattacctgtatgtccatagatcggaagcggaccgctgctttttcctaaatgatatcccactagcttcgcatattggagtggtccgatatctgcaatatgatcgtggtgataatgagaaaggagaacagcatcaagttcttctatatctatgtattgctgcagtttggaaagaacaccgctcccgcagtctacaagtagacgaaagccatctgattcaaaaagataccccgacgtcgcttcaccagcggccggaaaccctccatagcatccaatgacagttaacttcatcgacatttttccctccttttctaaaaatccccttcttacaatatacccatttttcatgaaaaaagcattcttcttgcctattgttacaaaacagattgacaattaataatctgttataatacaataatagcaacaaaacgtattggaggatgacaaatgctaggaaaaatcacagagttttttagaaatttgccctcaaaaaaatgcacaaaatgtggaaatgatttaatggaacaacacgagtgttacggtaatgaatgtgaggaatgctcacaagtaagttatcttaaataaggtaaaaaattgaattaaaaagcacttttttcctccgtcgtcagttggagtcaaaagtgctttttattttttctgaaaaataggtaaaaaggtaaaacccttgttataaaagggttttttagtattttcatctgatgagttttagttccgaaggcactttttattgacttgaatcaataatggaggttctaaatgttcattttttcaaacaattttgtattttcttaatataatttaatcgtggacgaaactctttaattttagttatactttaattcatatattaaaacttaatatgatgggaatattcctttaatgaatatgttagggaggaaatctatgaaaaaattaaaatttggattagctacacaaatcctaatcggtcttattctcggtgtcgttgttggggcaatctttttcggtaacccaggcgttgagacttatttaaaaccaattggagacttcttcttaagactcattaagatgattgttataccaattgtcgtatctagcttaattttaggtgttgcaggtgcaggtgatggtaaaaaggtagggaaacttggctttagaaccattctttattttgaaattatcacaacatttgcgattattcttggtcttgtgcttgcaaactttgttcaacctggtgcaggcgttgactttggaaatacggaaaaacaagatattagccagtatgttgaaacggaaaaagagcaaagcagcaaatcaattgctgatacgttccttcatatcgttccaacgaacttcttccaatcattggcggaaggtgatttgcttgcgattattttcttcactgtgctatttgctcttggcgtttcagccatcggtgaacgcggcaaaccagtgctcgccttctttgaaggtgtatcacacgccatgttccatgtcgtcaatgttgtgatgaaagctgcaccatttggtgtcttcgcactcattggtgtgactgtatcaaaatttggtcttgaatctcttatttcattaggtaagcttgtaggtcttgtttattttgcgctcgctctcttccttatcgttgtattcggaattattggaaagatgattggcgtcaatattttcagatttcttgcctacatgaaagacgaaatgcttcttgcctttagtacatccagctctgaaacagttttaccaagagtcatggataaaatggagcgcattggatgtccaaagggaattgtttctttcgttatcccaatcggttatacatttaacctggacggctccgtcttgtatcaagcgatcgctgcgcttttccttgcacaggtatacggcattgatcttacgattgtccagcagctcacacttattcttgtactgatggtaacatctaaaggtatggctgccgttcctggtacgtccttcgttgtattacttgccacattaggaacaatcggtgtgcctgccgaaggtctagcatttattgcaggtgtagatcgtatcatggatatggcacgaacagttgttaacttaacaggaaatgcacttgcagctgttgtgatgtctaaatgggaagggcaatatgaccctgaaaaaggacatcgcgtgatgactggacaagatgtacctgaaccgacacagctttcaagctaatgaaaaagaaccccgatcaatggggttctttttttatgctgtgattaatgacgattgcacgtagtgataaagaagattcgctgtatggacaagggaatcttcatgcgttcgttcaaaagcatgcgaggaatctattcccggaccaatcagtccatgaatgatatcatgccctgctcgaatcgctgctgatgcatcagagccgtaataagggtaaatatctagacgataatcaatattattctcttctgctaatgcggctaaatgcttgcgtaatccataatgataaggaccacttgagtccttcacacaaatagacacgctgtattcatctgttgattgaccatcgccgatcgctcccatatcaacagcgaggtattccaccgtttcttctggaatattggagtttccaccgtagccaatttcttcattattagaaattaagaagtgcgtcgtatgcggcaatgtgatgttttccttttgaatgcggaggatgagtcgcagcaaaagcgctacactcgccttgtcatcaaggtgtcttgatttaataaaacctgatgacgtcacttccactctagggtcaaatgagataaagtcccctacttgaatgccaagtgctttgacatcgtctgcattttgcaccttttcatcgagacgaatctccatattctcttggtttcgttttgcttttccagcatccgcatagacgtgaacggatgtttgatgcatcagaatggtacctgtgtatgtatgacctgctgctgtttcaatttcacaatattcgccttcaattgagttatattgaaagcctccaatgagtgcaagacgaagccgtccatttgatttaatttcctttaccatcgcaccgagcgtatcgacatgtgctgtcagcatgcggtgttccttgtcatcagttcctttaatagtggcaattaagccgcccttacgatttcgttttgtctcaatatttacatcttgtaaaaagcgttcaacaaagccgatcaccttttctgtattccctgacggacttggaatcgatacgagcttttgaatcagctgaacggtttcatttacttcagttgtcattcggcatttcctcctttgtgtgaaagcaattccttccatgtatgccttttatagcatctcttcttaaaatatatcgcttcgggttcaagatgtctaatttcaaatcaaaaatcctttctccatcaagagaaaggattcattgattaagcttcgtcttgtttcatttttcttacgttccaagcaaagtatgcggttgttgccgccatcatgatgatcgcaactgtaccgagaatcgctgcttggtgccataaatagctgtcatcaccgcttgcaatgatcgttctaaatccattgattgtatacgtcattggaagcagactatgaataacttggaagaacttcggtacaagctcaagcgggaatgtaccagcacttgctgcgagctgaagaactaagattatgacggcaatgaagcgtcctgggttccccattgttgtggctagcagctgaataatcgctaagaatgtcagactgacgacgattgcaaatagatagaagcgccagagactttccacctcaagaccaagtccaaagatgagcatcgtacttgcaatgactgcttgaaggataccgacaagcagaagcacgctatatttgctgacaaaccattcaaacgcatttctagggcgtccagcagggtctttcattgggaatacgacggtgagcattagagccccaacaaagagtcccatggataaaatataaggcgtgagccctgttccataattatcaatctttttcgctgtatcgttttctgttttaacagggcttgcaatcatattgtaattatcttgatttgcatcaatttcacctgtttcatcagcagcgcttttcaatttattggacagcttacctgtaccgctttttaaatctcccaatcctttatcaagcgattttgagccttcggcaagcttagatgtattgctttggatatttgttgaaccactttccagcttatttaacgcagcgctaagctggcttgatccatttgcaagcttatccgctccgcttttcgccgtatcaagctttccatttgctgtttgcaggccatcttgtaattggccttgacctgtttgaagcttcagtgcaccttgatataatttattcgtaccagatgtcatttggtcgatcgcattttgaatcgcgactgtagacgtgtacagctgttctgttttctctggcagctgtttgacttgctgcagctgcgcttttgcagatgcaactgcttgttgaacctcacttgcatcaggcagttcctgcaagtccgctaagctttgttcgagtccagacagatcaggcagttcgattttaggcaggctgttcagctgatccattgccgcctttttctcttcatctgtcatagagctgttttggataatgctttttactttagcatctcgatttgataatgcttcttttaatgaagcaagttttgtactgaacgtttttgcgtcttttttcacctgatcgagtttaggcgccatcttttcaagattcgctaattctggtgacgataagactttttctactgctgcaattttttctgaaaaggattgtgctttgttgtttagctgctctatgcctgctgtgaattgcggcattttagaagcgagctgctgatgtccttctcggcttgtgtttaatccttcggttaatgtatcaattcctgaaccaagctctccaaatttctgatcaatggtttgatagcctgttaaaagctgaccaagtccactgtctaaagactgtatgcctgtgttcagttcacccattttccctgcgaactgatgaacaccttcgctataggttaacgtaccttcagccaatttggctaagttgtcttttaatttcgtactgccatcttttgcgctttttgttccgtcatcaattttcttcgcgccatcgcttgcttgatctaatccttttgcaatcgttttgaaattatcaaagatgacctcggcgtaattttttgtgacttcttttgaaaccgaatcttttaatttgataatggcattattcgcaatttgtgacgctgcatagttggcgcccggattcgtataatatttcagattcgattttttcggatgcttttctagcactgtacttgcatttttcgagaaattctttggtatttccaccacgaggtaatagtcctcgttatttaatccttttatggccttttcatgactatcgacaaagttccatttaaaattatcgtttttctttaattcctttactaaatcatcgccgacttgaagggttttcccgtcataatgactgccctcatccaagttgacaaccgccacaggcaattgatcaactgtaccataagggtcccagtacgcttttaaaaatacaccactgtaaatcagcggaataaataagacagctaaaatcgggatcagtagttttttgctggttacaatgtctttccattgattccgaattaaattcattgctgttttcctcccatagatgaatgactaaatatacaatttggtcatttgaactcaaaaaaaattatgttgttgcagatagtccttttaagacataaagctccagcgattcagctacctcttcttttgttaaaggctcgtatcgcttttcccaatcaaaaatcaatgcaatatatagtttcaccatcacaaatgcagtcaattcaggatcacaaggcttaatgtcgcctttatccatcgcttcttgtactttcattttgatatagcgaatgatcatctgctccattttttcgatcatttccttgaccgctgacgtgccaagctccgcattttcctgaaaaatcttaattgtgagctggtggttttttcgaaattctaaaattgcaaagagtgctaagtgaaggttttcagagaaactattcttctcatcaattgcctcatccgcaattttcctcatctctagtaaaagggatgtgaaaatttcatcaaacaactcttctttgtttttgaaaaatgtataaatggttccttttccgacgttggcaagctttgccacaagatccattgttgtcgctttatacccgaattgagtaaatgccttcgtcgcaccatctaaaatcatttgtctcctatcaacactcatgatctcactcctgaaatgactatttgaatgttttggtcattaagtacagaaagtaatataccatatccttttcattagatgcaacaactttgttcacatttatgattcccaactctttttgaatgatccaaacacaaacaactccctttccatgacagaaaagggagttgttttttatgaaaatagatacgatacagcctctgagatggcggcttttccttgatcaatacaatcagggattccgacaccttcaaaagcagcacctgtgatataaacaccaggatatgattgcttaaacgtttctctcatgttcgaaatagctttctgatgaccgacgtgatattgcggcatacttgtcttccagcgagtcactgtcgtcaattctggatctgctttaatatccatgattttctttaaatcttcgagcacgatgctgacgatttgactgtctgactgctcgacaatcgattcgtcaccagcttttccgacatacgcacgcaatagcgtttttcctttcggagcggtatgcggccattttttgtttgtccatgtacaggccgtaatagagaaatcactgtttcttgagatgacaaaaccagtgccgtcatattcattatgaacatcctcttctttaaaaccgagtgctaccgttgcaacagatgtagaggtcatgtcatgcaaatactctagccctgcttctttaggaaacatagaataaatcgattgatgcggagtcgtgacaatggctgaatcggcaaaaagcgtttgaccgctgtctaattgcaaaccatagcctccatccgttttttcaatctgttttacttttgtccctttatagaccgttgtcagcttgagcttactttctactgcttccacaagcgactgcaatccttgattgatcgtttggaactgtccttgtttttttgcagtcacttgctgggctttcgcatgctgctgtgattttttcatcccaagaatcaaactgcgatgctgctgttctgtttgataaaattgcgggaatgtggacattaagctcaggcggtcaatatcccctgcataaatgcctgatagaagcggctcaattaaattctcaacaacctcatcacccacacgtcttctaaaaaattcaccaagcgactgatcttcggtctgcttgctttttggcaacacgaaatccatcgccgctcttgcttttcccgcaactgaaaaaagaccagttgtaataaatgggctgatttgagttggaatccccataacagcaccctttggcatcgggtgaagcttttcattgactagtacatacgcttgcccagtttcattattgacaagctgatcggacagaccgacatctttcgcaagctgcggcccactgacctttctttctaaaaatgaatcaggtccacgctcaatgatgtagccgtctttatataatgtttgtatttttccacctagcctagggctcgcttcaataagtgatatttgaatcggaagacctttttcttcgacttccttttccaaatagaaggcggcggctaaaccagtgatgccaccgccaatgatgacaaggtgtttttgattgtcatgcataggatcgccttcttttatatgattacttgctttcgtcaagcttctttaatacgactgttgccagagcatcaataaatgctggtttcgcatttggcatttctggacgatagtaggctgcaccaatttcatctgtcacgactttacattcataatcgttgtcgtataacacttcaagatgatcagcgacaaaaccaacaggcacatacacgaatgtttgatagcctttttgttcaaataaatctcgcgttaaatcttgcacgtctggtccaagccatggatccggcgtattgccttcactttgccagccaatttcatagtgttcaattcccgcaccttctgcaatcattttagcagattgtgcgagctgatccggatatggatctcctgctgcaataattttttcaggaaggctgtgtgcagacacaataagtactgcggaatctctttcctcttgactcattgatgcatacgtatccttcacttgcttcacccaatagtccacaaacttcggctcatcgtaccagctttcaacagacgtaatctgtagattgcctagcttgtccgcctcatcttgtgcacgtttgttatatgatttcacactaaaggtagagaaatgcggcgctaaaacgatactcacagcttctgtaatgccgtccttgtgcatatcagcaactgcatcctcgatgaaaggctcgatatgttttaagccaatgtacacatgaaattcaatgtcgtcttgaatgtcattcaagtgctcacacaaaccatgtgcctgctgctctgtaatttttgataaaggagaaataccgccgattgccttgtagcgatcctttaaatcttgcagcatctccggctccggctttctgcctctacgaatatgtgtataataacgctcaatgtcttcttctttatatggggtgccatatgccatgacaagaagccccattttctttttctccacaaccaacactccttcagatcaattgaaatagtttagatggatgattttttatgtttagctgaatagtcgtgaataaaatcggtcaacttctttaacgtatctggtgaaacatctggaaataccccatgacctaagttaaagatgaagtgatctgatttcatcccttgatctaagatgtcttttgctctttcttcaatgacttcccaaggagaaagtaaaatcgttggatcaagatttccttgtaacgtttttgtgagcccttcttttcgcgcttcgtctacactcatacgccaatcaagtccaacgacatctagcggcaggtcatgccaatctttcacgagatggcttgcaccaactccgtacatgatcattggtacattttcactcttcaactctgtgaaaattcgctgcatgacaggtttaatgaatgtccggtagtccgctgcatttaaagcgcccacccatgagtcgaagatttgaaacgcactgacccctgcttttacctgcgcgcgtatgtacgtgatcgtcatatcagctaatttgttcatgagcagcatccatgtctccggctcactgtacatgagcgcttttgttttatgatagtttttagatggaccgccttcaatcatatagctagccatcgtaaatggtgcaccagcaaaaccgatgagcggtacattcagctgctccttcgttaaaagctgaatggtgtcaagcacatatggcaggtcttcttcaggatgaagttccccaagacgttcgatatctgcttttgtccgaatcggtgaatcaatgacaggtccaatgccatttttaatttcaacatccactccaatagctggaagcggggtcataatatctttatataaaatcgcggcatctacaccatattgttctacaggaagtcgtgttacataagcacatagctctggctgatgcgtaatttcaaatagcccgtacttttctttaagggcacgatattcaggctgtgagcgtcctgcctgtctcatataccaaactggtacatggtctgttttttcccctttgcacgcctttaagaacgtgtcattaaaagccttcgtttttcccattacctttcattccacctttcgccttacactctctttgtataaggctcaaacactgcttttactataccgctttttcaaggcacggtatactaaaccggctcattgttcaaaaaatcgccgaatattaacgtccaaaagcctctggcttgacatatggactgccttctccttcttcttgcgtttgggtattatatggaaccaccttatacgccgcatctgaaaacacattggcatacggcattgtatagctatttgtgcctgtcactgagtcaattagcgtctcgtttccattcctcttttcataaatacggtattcaactcgtttatcctcctgcttgtcccaagacagctctaatgtaaacaatcctttgattttaaacgcatagcgggcttcaaatcctgatagtccttctaaatgaattggcgcttgaagttctttaatcccctctggttttttaaacgtttcattcgtcattcgggccgccgttaaaatatccttaaacagctgcactgggtattgacttccgccagttaagtagtgactgttatcggttttgtcataccccatccagatcgcacccgttgtactcggcgtatagccggcaaaccaagcatcttttgttgcacccttcacacctgaatatgtggttgtgccagttttaccagctaaatctccagcatatgaaccgctttgggctgttccgcctttgacgacttgctgcaacattcttgtcatattccaagcattctgcacgctaaacactcgttctggcttactgctatttttctttaccgtttctccttcatcattggtgattttctgaatgaagaaaggctttttatatacaccttcgtttgcaaatgtatggaaagctcccgcgatttgaagtggagaaacccctttttctaaaccgccaagggctatcgcaagtccttgatccgaaatatcgattcccattttctcgagatatgttttcgaagtatcaataccaagctggcttaatgtccacaccgctgctgtattcttacttttcatgagggcctccaccatcgtgaccttgccttcatactgcccatcgtaattctttggagaatagccgtcatagcttttttcttcgtcttcaagcagggaataaggtcggaattttttctcctgcagcgcaggcccatataccgcgatcggcttgaaaacagatccaggctgtctaacagcggtcaccctgttatagccccttgcttgatattctcgtcctccgattgctgctttaactcctccagactcattatcaataaagatggcactgctctcaggagaaccgctttttcccgggaaataacggttgtttttcatcgcatcgtaggtgaccttttgcagattcatatcaatcggaactgttatggtataacccccttgaagcaattgttcatgtgaaatggaatactctgattctgcttccttaatgataagatcgacatagctgtccacccaaggcgtttctgatttctttttcaaatgaatgcctagtgttctcccttttgcttctactgtttcggttgatgataaatacccttgctcattcattaagttcaggatcgtatcccgtctttgtttatttttatcagggtgtaaaacaggcgagtaagtagacggcgcctttggcatcgcagcgagtgtcgcaccttcactgacagttaaatctttcacatctttactaaagtaataattggctgctgcctgaataccgtagacgccatgaccgaagtaaagctgattcaagtacatttcgagcagcttatcctttgaataatctctttctaaattaatcgcaatgatgacttcttttgttttccgcaaaaaggttttgtcatttgtgagaaaaatattttttgcgagctgctgagtaattgtactgccgccctctacctttccacctgctaatatatctcgataaaccgcccttgaaattgactgcgcatctattccatgatgctcataaaaccgcttgtcctcgacagatacaaaggcttttgctactttatcgggtacatcctttattgacacggggtcccgattttctgaatacatacttgtgagttcttttccattctgatcaatgatttgggatgaagcgtgaaatacaagcttcttttcatctatgacataatgtcctaaaaataaaatggtcagatagccaataaatgaaagtacgatggtacttcctgcaatgactaatggaatgattatcttctttttcttcaaattaggtcacctcattcctttatacggatagtatgggatgtattgcttcataatatgttttatggattgactaccaaagaattatatatcattcttttgttatactatcaagcgggaggcggtttagatgaatgtctatatgacatatggaacagcagatttcttgcataaaatcgcaaaaaaacacgatcaggaaaatctgctttatatggtcggaaaagaacaagcagctctttttcatgagacggagggtgagactgtttttaaagcccctcatgcctatgatgtgatttatgcaaaaggtgagcttgtccatactggcttcgtcaccttgaatcatatccctgtgaagcttgaaagcagggcactgtttgaatctactttcaagaagaagacgaacatctcagaacatcagcggggcttcaaggctcttcgagtgttaagaccgaaaaaagatgaagaagtttatttaattatgacgctttgggaatctgaggacttatttgaagactttcaagaatcagaagcattctttcagccaaccgacgatactggctccatcttctcacgtcctgcttatctcacatcctatcatgccgttacagacaattaaggaagtgctgctctcagcacttcttttttcatgaaaaaaagcccaatcgctgggcttttcattttaacgtcgggatgtcagctcgtaccgatgtatgatcggctgaagtacatagaaattcaataggagccatcctaataagatcggccacttcaacataggcgaagcctctttcaattgaatgagcatcaccaatagcggaatcaagcagatcatgaaaaaactcattttcgatacaaaggtttctttgatttgatgccgacagcttggacacatcatcattttcgtatgtgataaatgaaacttttcaacgaaagaaaacacttttgaacaatttgggcagcttcccaatacaattcctccctttccccgcttcatagcaacttcgacttattatgtcaaatgaccttttgatgcgcatacgacatcctcttctgttgaaagattctaacaattaccatacaatcagtaaaagagtatgaaggaggttttcaaatcaatgacaatttctactttacaaaaaagcatcaatgaacgtcttgatgaacattatgaggaaatggttgaaattagacgccatctccacatgaatcctgaactttctttccaggaagaagaaacagccgctttcatcgcaagctactacgacaaattacatatacccacacgtacacaggtgggcggccatggtgttctcgcctttatcgaaggagcttctccgggaccggcgattgccctcagggctgatttcgatgcacttcctatccatgatgaaaaggaagtgccttacaagtcgacaaagcccggtgtaatgcatgcatgcgggcacgatgggcacacagcgacactacttgtcttagcgaaaattttgaatgagcaccgtgatcaattaaaagggaaaatcgtcctcattcatcagcacgcagaagaatatgcgccaggcggcgcaaaaccaatgatcgaagacggctgcttagacggtgtcgatgtcatattcgggacacatctttggtcaccagagccttgtggcacggttctttataaaagcgggaactttatggcagctgccgaccgcttctctatccgagttcaggggaaaggcggacacggcgcccagcctcacttaacgaaagatgctgtccttatcggttcacaaatcgtcgcaaacttgcagcaagtcgtagcccgtaaagtcaatccagttgattctgctgttgtatctgttggaggttttgtggcagagaatgcttttaacgtcattgcagattcagcagttttaactggtactgcacgatccttcgaagaaagtgcacgacacaccatcgaacgagaaattgaacaggttgtaaaaggggtgtgcgacatgcatgatgccggctacacatatgaatatgtaagaggataccctgctgtcaaaaatcatccaaagccgactgaatttattgctgacatcgcaaaacaaacagatggtgtcacagaagtaaaagaagccgaaacccaaatgggtggagaagattttgcttactaccttcagcatatccctggtaccttcttttacacaggcgccatgccggaaaacagcgaagacgtgtatccccatcaccacccgaagtttgatatcaacgaaaaagcaatgcctatcgcagcaaaggtactcgcccgtgccgtcctttcctacgatgattaaaaaaagccgctggcaaacagcggcttttctatttcatttctctcaacacccgtaagtgaaacacatgacgagcgacatctccgagttgtcctgtcaggtgatgatttgctacaccgccaacagcggctccgacgatcggcattaattgaaacagcttcactaggtcaatgtaatctcgatactcctgctgaaagctgtaccaatccattttctcgcggctcgtttcccaatcatctatgatgctcatcattttttgacgatgcgcactgccggaaaaggcaagttgaaatatacagagcaaaaagagtctttcctctttttgagacaaatcaaagccataaatacatgccagttcataaagacatttcatcttgatgctaagcagcagcggaaagtctgccataccgagcaaaataccacctgcacctgttccaattccttcgatcgcagctgccttttgatagtacttcactttctcctttgccagttcattccgctcaatgatggttaattgctcatcaatgactgaaaatgaagtgaagtgagttcctgatacggtggattcaaccattgttttgaccgcacttgtgatgacttgatgaaacctggcagggattcgtcggttcacctgctgctgaactccttttgaaaaccgttcgatctttgatggttttcttaaaaaacgcgtttgaaaaagaatggcttcttcatataactcccgttcagctgcattcatccgttcccctccttgatgtcatcatacgctcgctgtcagtaacatatctctgctacctcatctttttcaatcgactgagtacgtaaggcttgaagaggacaagtacaaatgccagtgaaatcagaagggcaagtccacttccctgccatcctcctgccggtagtactgaacaactgagcacaatcgcttggatgatgagcacgttacggacgagaataaaaaagctccgatccttttcttgatgagtaactggataaagtgcctgtaatgaaagatgggcaaagtgcttcgttaacggcacaagctgaacacctgtgataaacacggtgaacaagacaagcagtgcgcccacccagcctgctgcacctgtatacaaaataatcagcacaaacacggctgttagcctaaacacgagaccaaaatagtcatttgatcgtaagaatgccctcacatacatgtaagaaaaagttttacgctggtcatacggaacaaattgcaaaagccagtccatataggctcttcttttcacctgtttctttaaatgaggcacatctgtaaataagtttgccaaacgataaaaacgctgttttcgttttaattcgtcagaaatatgcaattcccattgaaaaggctgctttttgactgcatttgttaagtaaacaagatagacaccatagatcagataaaaaacgattgcgattgcataggatgcctgtaaaacggtatagattaaaatcatattcaatagaaaacgaaggactgcatcaagccatctcatctgttttccttgaaaatacgtcattctccattgaatggctgtattcaaacccttaatcaaaatcatttgcgccaatataagcacatacatcttaatgccgcctgaagacactgccgaataaagcgggagtgcgacaatggatacggcaatgagaggaaacagctgagaaatgaagctaaagttaaaagcttgttttaaataaggctccatcttcccttccaaaggaagcaaaaacacgagatctgcttctttgatcaacgtccgcacgtaagagcttgtcagcaccaatgagaaaacaactgccatgacccagtaggaaggaaaatgagctggaatttgtttgagccagttactataccagctcgctccgcctgcaaggaaaaaaatgagcacaatgacaagatgatcattgaacatgtattttaaatattttcttgtatcttgtatgtgttcctctaatcgggatttccaaatgctttgtgtcgttttactcatagctttcttcctttgttaattccaaataaagatcatcgagtgtcgcatctctcatattgaactgttctctcagctctgtcagtgttcctttcgctctgatttccccttcgtgcaaaataataaaggaatcacaatagcgttctgctgtcgccaagatatgcgttgacatcaggacactagcgccgtttttctttgcagcattcatccgttcaagcagtgcattgatggcaagaggatcaagacctaagaacggttcatcaatgatatacagttctggttcaacaagaaatgcacacataatcatgaccttctgcttcattccttttgaaaaatgagcagggaaccacttcaaacgtttctccattcgaaattctttcagcaatgacggcagccgttcatctaattgttcttttgatagcccataagccatcgctgtcagctctaaatgctcttttaaagttaattcttcatataatacaggtgtttctggaataaacgtaaactgcgagcgatacgcctcttgatcctcttgaagggttcgtccattcaattcaataacacctttatgcggtttcatgagtccaatgatatggcgaatggttgtacttttccccgccccgtttaaaccgatgagaccgacgatttgatttctttctaattcaaatgagatattttttagaacgggattcttcgtatatccacccgttacatcttttacagtgagaagggacatgaattcgttcctttctttcgtttttcctttatagtaacaaaaacgaaaggtaatttgaaatgtttacctatagacaagtcctgaataaaaaataggcgtcttggtcatcataatgtatgtagaagaaatgaacttgatgaccaataagtaaatgaggtgtttgttaaaggcaaagaaccgcataacaagttggtttttcatctaaaaaccttagcttctgttttgcttcactgattcttgatttttgtgtcctatacaatatgtatacgacaaaccaaaacgtcaaatgaggtgtttacggcagaaatagcaggcatatgaattctttatttcagtaaatagagaattcaaaaggcatatcgaatgaaagcatcagcatttcttctgcaggagcaggatgagcgaccaaaggagttcgcttatcctgttttcttttttgctcatttttgtgatacgatgaaggaaaatgaatgaggagtgacatgacgtgagcgattgtattttttgcaagatcattgatggagacattccatgtgcaaaagtatatgaagacgagcatgtattggcttttctagatattagccaagtaacaaaagggcatacccttgtaatcccgaaaatacataaagaaaacatctacgaaatgacaccagaagtgtctaatcactacttccaagcgattccgaaaattgcaagagccatcaaacaggaatttgaacccattggattaaaccttttaaacaacaacggcgaaaaagctggacaatctgtgttccattaccatatgcatatcattccgcgttacggcaaaggcgatggctttggtgccgtatggaaatcacatcaagatcaatacacgtcagaggatttaaaagacatttcttctgccatccatactcgccttacctcatcttaatagatgaggtttttctcatttctgccccctctttttatccccttcatttcttaatagtaagatatttagaacgattcaaattttttgtccaattgcttcaaatttgtgataggatggttttatcttttgatccattaacgcgagaaatagggagagattgtgatgaagcgaacgacgaattttaatgctggtccggcggcactgccgctagaagtgcttcaaaaagcacaggaagaacttgttgattttaaacaaactggaatgtctgtgatggagctgtctcatcgcagcggtgaatatgaagaagtccacaataaggcaaaagcactgttggtggaactgatggacattcctgaagattatgaagtcctctttttacagggcggagctagccttcaatttgctatgattcctatgaacttcttacatgaaggcgaaacggctcatttcattcaaacaggcgcttggtcagaaaaagcattatcagaagcaaaagggtttggtgaaacatctgtgtttgcttcaagtgaagacgacaactactcgtatattccagaagtagatgcctccgatttaacagatggcgcttacttacacatcacatcaaacaatacgatcttcggcactcagtggaaaacgttccctggtacatcattaccgctcattgcggatatgtccagtgatattctcagcaaaaaaatcgatgtttctcaatttgatctcatttatgctggggcacaaaaaaacttagggccttctggtatcacgattgtgatcgcgcgcaaacgtttattagaaaaagagaaaagcagcacaccgaaaatattaaaatattcaacacacgcaaaagctggctctctttatcacacaccaccgacttttgcgatttatatgctgtctcttgtccttgaccatgtcaaacaggctggcggtgtagaagcagcggaaaaacgcaatgaacaaaaagcaggcattctctatgacacaattgatcaaagcggcggtttttacaaaggacacgcacgcactgacagccgatcgcatatgaatgtcacgtttacccttcgtgatgatgcgctcactgcttcctttgtagagaaagcaaagcaggaacaaatggttggacttgccggccaccgttctgtcggtggatgcagagcttctatttacaatgcggtatcgattgaagactgccaaaagcttgcggactttatgaaaaagttccagcaagaaaatgagtgaaaaagcttttctatagagaaataaatttgttataataacgagaaatataaagtgatgactcttgcaataaatgatgagccatattattggagagttctaagagcttagcagaggagagcatagaaatgaaaacaaaagaattagtgattatgtcattgcttgcagcaatgggagctgttttgcatacgattttcccgcccatctttttcggaatgaaacctgatatgatgctggtcatgatgtttttaagcatcatccttttcccaaaggtacagcatgtagtggttattgccctcgtaactggcgccatttctgcattaacaacaggtttcccaggcggacaaattccaaatatgattgataaaccagtgacagcctttatcttcttagcccttttcctatcttgcatgaagataaagaacaaagtagtgcttaccgctgtgttaactgcgattggaaccatcgtatccggcgtgattttcttatctgccgcattactgatcactggactgccagctgcattaccggcacttcttgtaggcgtcgtcctgccagcagccgtgattaataccattgccatggtatttgtcttcccaattgcacagtccattctcagacgtgcaagaatgatagaagttgcttaacgaataatcgaacctcttcataatagatgaagaggtttttttcatgcttttataaaagaaaaagggttagcagcaaaatgaggagcgaaattcctgcacctgccgcacacacaagtgctttttgctttaatacatgttttggcggataagaccctgcataccccagctgtcttgcataatgaatagaaccacctgtaaaaacgacaccgatacacgtaaaaacgaacagaaagacagacaaccttctcccctcccttttcttcaaaagtatgctaaaataaagcaagctatgtatggaagttcaatgaagctgatcgtcagctcagagagaacatgcgaatgtgtaaaatttgactagaggtgatttgaatggctagtggacgttctttattaacaggattatttgtaggcggtctcctcggaggtgcggcagtgctcctgacgactccctcttctggcagagatgtgcgcggaaagatgaaagacggctatgacaaattcgaagatacgctgacaagattaaaaagagatggacaagctttaaaagagcaaattgttgaaacagcaaaagaaagcgcagaggttattaaagaagtcggaactgaattacaaacatcgattcagcaatggcgcgaagaaatcaaacctcatcagcaggatttgcaaaaggaaattcaggaaattgaggaaaagctcaaacaactggagaaaaccttacaaaactaatatactcaagaaaaaatattcgtttacaaaagtgtgcggggtgcgtatcccgcactttttttgttgaaaaaaggttattttgtcaatgtttttcatgagttttaaaaattcttgaattttcagctttattaatctttattttattggcataatagaattacaagaaaaagagaagtaggtgaaatggatgaatcattcggaacagcctttcgatgtaaaagaagcacttttattcagtcaaagaatggcccaattgagcaaagctctttggaaatccattgaaaaggactggcagcagtggatcaaaccgtataacctaaatatcaatgaacatcatattttgtggattgcgtatcaattaaaaggagcttcaatatcagaaattgcaaagtttggcgtcatgcatgtatcaacggcgtttaacttctccaagaaactggaggaacgaggatttttaaaattttctaaaaagttaaacgataaacgcaatacgtatattgagctaacgccaaaaggcgaagagacattccataaactactcgaagattatgacccggcacgaactggtattgtcaaaggcgcacagccgcttcatgacatttacggaaagttccctgagattttagaaatgatgtgtattatccgaaacatctatggtgaggacttcatggagatttttgagaaatcgttttcaaacattgagaaagactttttgaatgagcgaggaaaagtcacgaaaaaacctgaggaacttgaagactcagctgatgcagcagaaaaagcggctaaagcaaatcaaattgtttaatgatctttataaattcattcattaacggctgaaacagcccttgatcatgcaatgcaaatatcgtctcatgcacatccagcttttcaattaactgtcctgcaaaaagcgcaagcatatcgtcaaacatgacgtagccttgtgctttttgcttgtccatttcctctgaaagctcagcacaaatacgctcaatttcctgcgcctcttctttcgatacccgctgtctgatcaataatgcataatatggataacggctcatatcggtcgccgtcagcaaaagttccatataatattcgagctggctcattcgttcctcaatactcatgtacgttccctctttctcttagtctttctattctagccgaaattactcattgacgaaagagacgaacctccctcttctgtctttttttcttgaaaaacccaaagtttcctctctttattccatatgaaggcaacattttatttttttttcatgaaaaccattgatttttatcctcaggaagagtaaattatcttgagatattcaattagttttttaagattggaaggatgaaaaatgaattgttggaagaccattaatcttgaaaaggattatggttatacaagactgctgatttcagccataagtcttgctatactttttttcattacggcttttttatgttttcaactgactcatcctgaaacgagactaagcagtcacaacgcaccgctttttgctatgcttttacttgtgacattgcttgtccaccgtgtggttcacttgatcccagtgatgaaaaacaagaaaaaaatgacgctatttaaacgaaattgctggcagcgtgtgccaaagaacatcatgctttattcacttctcagtccattttgtgtgatttcaccggtttactttgtgttaggtgtggcgcttcctatgtatgcacactattttatcatcatcgcaagtattcatgcaggctattgtttgcctgactttttatttgcatggaaactgcttaaagcacctaaatcctgcatcatcgatcaagcccaagacgagtttgatattttagttgaccaaacatcctcatcatgaggtttttaaagccaacttctatctttttcataaaaaatttggtaatgtagtatgggaatagcatagagaggggggatctccgatagttttattttacttcatcgtctttgccgcgtttattgtgtattcaataaacaggcttactaatacattatgccttgtcagagagattcctgaagaacggcaagataaggtgtttcgctttatcaatgtatcgatactgatcttactgatctcatcatttgttgaaattaccatatctatttaagatcaaagcaaaagctgccagtttgagggcagctttttgtgtatattgattaattagcaaatccaagatgcaccgataatgatcaataagatgaataacacgacgactagtgcaaaaccgccagcgaagacttctcctcccatgtaaaaacacctcctgccagttcttcctctgttctaagctcagtgtatgcaataaaattgaaaacgtttaggcacctgtcatcgtttaaaaaaagaaccgcccgcacgcatggcaggacggctcctttctgtcacagcgatttaattaataaagatatgctgcaccaacgatgatcagcaaaatgaatagcacgaccaataaagcaaatccattagaatatcctgctcccatataattcagcctcctttttgtgatcactatatgtgtatgttgcgcgcaaatttttgactagacgaatgccctcccatttgcatttctttttacagcgtgtcacaatatgttatgatacaagcaatgataaataaattggaaagattaggagtgttttttgaatgaaaaaaatggctttagcagctgtaacagcagttagtgttttaactcttggcgcatgcagtagcggtgataaagatgtcatcgcaacaacaaaatcaggagatgtcacaaaagaagagctttatacaactcttaagaaacaagcaggtggagatgctttaaatctacttgttcaacaaaaggttcttgctgacaaatacaaagtatctgataaagaaattgataagaaaatggaagaatataaaaagacacttggtgaagatcgtttaaaacaacttcaagatgaattcggaaaagattacatcaaagatcaagtaaaatatgagctgctgactcaaaaggctgccaaagctaacatcaaaatcactgataaagaagtaaaagcgtattacgatgacctaaaaggcaaaatccgcgcaagccacattttagtagctgataagaaaacagctgacgaagtggaaaagaaattagataaaggtgaaaaatgggatgctgttgtgtctgaatattcaactgataccgcttcagctgcacaaggcggagatgtaggctggttcgcaaaagaaggtcaaatggacgaaaacttcagtaaagctgcattcaaactaaaagtgaatgaaatcagcaaaccagtgaaatcacaattcggctaccatatcattaaaaagaccgaagaacgcggtaaatacgatgacatgaaagcagacttgaaaaaggaactaactaatcaaaaacaagcagacacaaatgaaatccaaaccatcttaaacaaattggtgaaagatgcagatgtgaaagtaaaagataaagagcttgaaaacacgttcaaagaaaagtctcaacaacccgcacaaaatcaacaaggtcaataatcacaaaaaaccccctctgcaatgaacgtgcagagggggttttttatgaccagatttaagcaatcgagtgatcttcatgtgccgacgtttcctgggatcttttcacttgctccccctgacgtctgcgctctctttcttgctccattcgctcgataaaaatttctccttccttttcaataaaggattgatcaatctcttgctcctctttggccgttgtcattaatttatacgcacagaaaataatgccaatgatacatgcatacacccaccatggaaaaaacaacattttttcatcgcctcctttttttcagaacagctctctcttcccttgtgttacatgcttatgcaaagagaagacaagttatgaaaaaaacgcccgcataagcggacgttttgacatggttattcgtgaaaggttggtttataaaatgaacgattctctagcgcaaaaatacgttctgtatattctcctggcttcacatgctcaagcgcacgatccatcatattcatcttcgcatctaaattatcaatatagtggagaatttcggcttcctttaccattggtggttttgggctaccccactctccttttccgtgatgacttaggactaagtgctgtagaatcagaatttcttctgaatcaatgccaagctcctcagcagctttcgcaatttctgtcaccataatcgaaatatgaccaattaaattcccttccaccgtataggtggttgagactgggcctgaaagctctttgacttttcctaaatcatgaagaatgatgcctgaatataaaagatctcgatctaaagatggatatagatcaacaattgatttagccaaatgcagcatagacaccacgtgataagcaagaccagagacaaattcgtgatggttttttgtcgctgctggatagtcagcgaattcctgtccatatttttttagcaaatgtcttgtgacacgctgtatattagggtttttcatatcaaaaatatattgcataatcgtatccatcatatcatgctttggaataggagctgtttcgagaaaatcatcgattcgaatttgctcattttcagcaacagggcgtatattcctaagtttcagctgattcctcccgcgataatgatgaatatcgcctactaccttcacaatggtttgtgcggcataggtttgttcatcattctgcttcgcatcccatagtttcgcctcaatatctccactttgatcttgaagaattaacgttaaaaatggtttgccattactcgcaatccctttagtagatgatttaattaataaatgcaggtcaacttgttcgccgacatcataggtcatgatccctttagccattcaataaaagctccttccatgtttctgctcatataagtataacataagtcattatttgtcaatcattccactgctaaactcgtaacctgtccatcttctgccgcttgcttcatatgctcatgacaggtgaaataaaacagctgtgtttcaaaacgtgtgagttcgttcatcatctccagcaatctgcctaaacgcacgtgatcgaaatgaacaaagctgtcatccatcataaacggaagctgacaatcttgctgatgagacaaagcaagcgcaaaacgaatcgctagatagacctgttcacacgttgcctgtgaaagctcctctggacggaatagtcgtccatccattcttttcaccatcaggaaatcatcttcaggtgaaaacaaaattgcttcataacgatcatttgttaacggttgaataaaactagaggctgtttgaagcaatgcaggcagccttgtttctttatgctcattcaatttttctcgtatgacggagcggacaagctgaatggccgcccatttttttgcgaggtgcttcgcatgctcctgctctgcggcaagctgatgagtcaaatcagacaccgttccagaagcttctatttgccggatttccactgctagttctgctaaacgcttttccagattctccgcattcaattgaatgtcatgaaggtgctgctttgcttctgcacactcctcctcaaggagaagtagtcctttgcgaataatccattcctcctcatcaaaacaaccgcttctatgaagctcttgattcagctgctgcagctccaaaagccgttcccggtattctttcgatagatgagaaagtacttggtaatcttctttggactctgcttctacttgatgaaaaagctcatcagtttgtttttcgtaatattgaatttcactttctagtgtcgcgagctgctgcatcgcatgttgaatggatacatgtaatgtttgacgttctttttctcttttcgcctcatcttccaatatctcttgaaaggctgaaatattctcctgcatagttccttcctttttttgaaaaatactggttaacgctgaaaccttgcgctcataaatcgattgctgatcggagagttcttctatttcacgctgaagctcctcatatgccgctgtattgatttttaattgttttagaatatggaaggcctctactaggaaagaaagctcagacgacaagccaagctgtctcttcttttcctctacttgctgctggacaggctccagctctagctcccagtcttcatattgccggatgattctttcgtacagcagctccttctgcctcataagtgtttcagctgaagctgcctgcacttgaaaggaatctaaggcggcttcgccgtttctttgtttcatagggctcatttgactggatgagtaaatgacaaagaagagaaaaacagaaaatcccgcaaacgagagcgtgatccaccactctgttaaaaagaatagaacaaacagaaacaccacatcaaatgcgatcaagccttggaataacaacgccagggaataaacccgtttctttttcgatcttgtccccttcgcttcatcttctgctccgcgcagtctcacttcttgttcctttaatccttttagcgcggattctgcttcgtccagctcatgtcttgcgtgatcaaatcgttcatctaactgcgcttttctgtccatgagacgaacgtattgagtgacagtctcctttaattcccactcgaattcaagcgaatcgtcgatttgttcgagctttatcgggcgctcccagtttaactttgcgaccgcttcgtctattttttgtttcaatgaatcacggtttgcttgacactctgctatgcgctttttcacaagctcaacattagatgcttcatctacgactcgtttcatctccataaaggtttccttgtcataaagcggttgaacttgtacgagtgaggtttgcaaatgatctaacctctgtttcagtgcagtcaattgagcctttttcgggtgaaggtgtgagtctaatttatccagctcatgctcagtttctgctctaaaacgtttgacacggtctggatagcgggctaattcctttttcaactccacttttttctcaatcatgggatacacttgaatggattcagtcagtttctgaaggtgttcttccgcttgcttcatttcattttgaagcttttcgatcgtctccgttaattcagaatgctcccgtttcttatcgatatagctgccttctgccaatctcgcttgtttcagctgacctgccagctcttttaagcgatcaagctgctgatttaattcaggtttgcggccatttggtttaaacagctgctcctgctgctttagcagcctgctatccatcttggtggctgcatctgagccaaataaacttgagaaaagtagaaattcgcctatctggtcctgattcaaggcttggacattttgaagtccaaacacatcaaacgaatagattgattgatataatctgcgatccgttccctttaaaagtgtttgtagaaaagcttcgtctttcacttcaccattcggtaaaaacacctgtgcttgcccaccgcgatcggatgttctctcaatatggatgacgcctaactcgtcatcttggcaagtgagggaaccaccataaaaagaaccctgcttcgtcttgtacatcttgtttttcggaaaaccaaataacatcgattcaataaacgttttcaatgtcgttttccccgattcattcagcccgtaaactagctgaaaaccgtcatcagaaaagtgaaaggtccgatttgaaaattttccaaaatgggcgatatggagtgaacgtattttcattgtgcctctccttttctcataattgcttaagctgttctgtcagcagcctttgtgcttcttcttttatatccacttcatcctcttttgtaagagcttttcctgactttctataggttgggtgacgcttgatcggtgatagaagctcttcatatacctcaaactgtgaaatttcagcagtgagttcctttaaaaaggaatcttctggataggcgacgtcctcgtttgtctggcagtcaatcgatatcacccaaacgaatacatcttcatcttcctcctgttcatgaagaacggccatcagctcctcaagcaactcaagctgcgtatgctcaaagtaagaaggagaatcacccgtcaattcaattttcacaaaatgagggacgccttcttctttcagttcaatgattttgttatccacaagtgtcacaagatccgtcatatgaaccgtctctgtgatgtctatttcaagtgtctcaaacatcacatccgcacagctaataaattccgctgccgcagaatcctcagagagttgaacaacgtaacagcctttctctcctgtttcttttatatgtctgccctgcatgttaccagggtaaataatcaacgggtcttcatgcagaagagctctcttatgtatatgtccaagcgcccaataatcgaaatctcgggaaaggagctgctcaagctgaaaaggtgcatatgcgtcatgaccttcttgtccagctaatgtaccgtgaagcatcgcaatgtgataggcagcatctgtctttttgacataatgagaggtcatattttcatagacagcacgctctttgtagctaaatccataaatacttgcgacaagctgatctcctctatagtaggattgctcacttggggtactggttgaaaaaacgtgcacattctcaggccactcaatcggtgtccattcaccgcctaaatgatcatgattaccataaataataaagacttcaatcccttcggtttgcagtcttagaaactgatttcttaaaaacagctgtgctttcaggctgcggttagattcgtcaaataaatctccgctcagcagcacaaagtctactgctcgagcaatggcgagatcaaacatattcttcgcactttgaaatgtactttctttgagccgcttaaagggtaagctagggatattcgacattcctgcaaatggactgtctaaatgtaaatctgcggcatgaataaaggtgagcttagtcaaaagtctatctccttgtccgatactgtcattgtccatattttatcatgccatttttgcgaatgcacgttctatcactctcattctaaaaaacacatttttaaggggtaaaaaagaggttttgtcttattccttgtttaattacatagaaaagcagaggaaaggaagatgaggaatggagaagacatactttttaactgtatttgacccgtcaggtgagactttactaaatgaaaaaatcacaacagatagtgatgaaaaggcaaaggaattaggtcgccatcgcttattagaacagcaatacacgaagcattctcatcggctcgttgatgatgcaggcaagctgcttttatttgaacgttaaaaaagccggcattcgccggcctcacattcgtttatacattctggaacacaggtcgtcttttttctaaaaaggcctgaatgccttccttatgatcatggctttgcctcagtctagcctgtgctgccctctccttttgaagaacggctagcagctgtgattctgactgctggaaatagattcgctttgtctcgataaatgcttgaagcggcatgttcataaacggcttcacacataccttttgatgcgcatcaacttcctcttgaaatacgccgtctgcaaggcgcagctttagcgcttcttctgccggaagcttttgtccgctccaaatcaattgtttcgcggtttgttcactgactctttttgtgaggaaaaaatgccctccgccatctggaattaagcctactccattaaaattcatggcgagttttgcatcttgatgcataaacaagtagtcacagcttaaagcaaagctaaaagcaaggcctgccgctgacccgtggacaagggcaatcgtcacttttttcataccagctaaagaaagcgtaatcccctcgatcaaatccatcacacgatggaaatcctcttcactttcctgcttaagcatcatgccaatatctccgcctgctgaaaatccttttcccgcacccttgatcacaacgacttttgcactactatcctccgccgcatcacatgcctctttgaattcagcaaacatctccacatgaaatgaattgtaagcatccggcctattgaaaacgatttcaaaaatatccccgtctagctgacaattgatatatgtcatcatccatcccccttttttaaacacatgacttacttccatttcaacccgaataatcctttttcctctgcataaaaaatttcaggatcagttgataccaaaacaagcataattattgaaacgaaaaatatatttttatatagtaaatgaagaaagaaattgatggtgaaaggaggagaatggttgatcaggtgttccctattcatattagttcatttcatcgtcatgttttctcctttttcaaatgtcgtttttgctccacaagcagaagcgagcacacctagtcttatttctccatccatctacgatgaagaaatacacgctgtgaagacacctccattttcaaaaaaacatgcctcttctattctattaaaggacaaattatcactggctgattcaaagatttttcttctaaagcctgctccatcagctgtgttatcgattgatctatgttttttgaaaatgaagtgtgcgatccccattatgtatcaatcaaattatctatactgattcattttatttcatccgtattcactatatgaaaatcacaacctatcatattcggagggataaaatgaatattaaagaaaatgatcttcctgggatcggaaagaaatttgaaattgaaacgagaaatagagaaaagatgacgatcgtgattcatgatgatggcagacgggagatttatcgttttgatgatgatgatccagatgaagtgctgtccaccatttctctcgatgatgctgaatcacggcaaatcgctgcaattattggcggcatggtgtataaaccacaggcactcgaaaccattgaaatggccttcaacgacttgatgattgaatggtttaaggtggaaaaagaagcaaaagcggttggacatacactcggtgatttagatgtgcggcaaaactatgaagtcaccgtcattgcgatcataaagcatacaaatgaaaaattactcaaccctggtgccgaatcgattattgaagcaaatgatacgctggtcatttcaggcgaaagaaaacacttaaagcgattgatacgtgattttctttcaagagggggagagtgatgaatggatcatttagtctttgaagttgggacggcactgattctcatcgccatcgccagcttaatcgccaataaaatgaaattctcaatcattcctttcctcattgtccttggtatgatcgttggtccgcatgctccaaccattgggatcattgatctaaaatttattgaaagcaccgacattatttcgttttttggcagaatgggcgtcttgttccttcttttctaccttggacttgagttctctgcgggaaagctcattaaatcgggcaagtccattgctgtcggcggatctatatatattttgattaacttcagcttaggactgctttacggctttattacagggtttggggtcctcgaagttctcattatggcaggagttatcacgatttcatccagtgccattgtggccaaagttcttgttgatttgaaacggacagcgaaccctgaaactgagttaattcttgggatcatcatgtttgaggatattttcctcgctgtttatttatccgtcgtatccggtcttgtccttggagatgccacaactgttggcggtgcattattatctattttcattgcttttggttatatgatgcttttctttatcattgcacgtaagctgccgaaacgattaaacaagttattcgatatccgttcgaacgaagtgttcatcattgtgatttttgcggctttattttttgtcgcgggtttctcagagacgatccatgtagcagaggccattggtgctctcttacttggtcttgttttctcagaaacagagcacgctgaccgcattgaacatcttgtggtaccatttagagatttcttcggagccatgtttttcttcagcttcggtctcagcattgatccatttacattaggtgatgcattttggcttgcgattggcgctgtggtcctcaccttcattgggaatttcactgctggaatgttcgctgggagaagagctggattttctcataaagcgtcttctaatattggtttaaccatcgtatcacgcggagagttttcaattattgtagccgagctcggtattgcgggcggacttgccgctaccttaaagccatttgctgcattgtatgtcttaatccttgcgatattaggtccactagtgacgaaggaatctaagcgaatctatcaaatcctaaacaaagtgttcaaatggcaaacagaaaaaccaaaagcgaaaaaagaaacgacaatctaatgaaaaagggccctatgcttgggccctttttatctcttattcaaattgctgaaaagctgtttcttgcttgactggcgcttctttgaccccgcgaatcgtttgaatcactttctggttgcggtagatggatagttttaaattggtcgccgctgttccatgagagtgatctaggtgcgtgaatgtaaagaaatgatgcggacgcttgtctttgaacacaagcctgaagtcttttgtcactttaaaatgttcctcactttcccattcaatcaaaggttcatacgcactaaaccacgccgggatattcggtgtgtaccctgtagccaatacggcacgatctactgttatactcttttctttctttagctgccactgctttagtttcagcttcagagactgattctcctccacctgaatcgcttcaagctcggtcattggctgaataatcacagatggctcttcgccagaaacagaccgatgatacaattcttgataaatgcgtgagagcgtcgatgcatctatcccatttcttaatccagtcagcctaggcaatgtgttcattcgttcttcataaggaagcgaatggaaatattcaacgtactttggtgtaaatagctcctgaccaagctcagccgtctctagctctctaaattcactagatcgcgtaaaccaagatagctgctgccctttcttctgatgctgaagcaagtctaagaagatttcggctgcactctgcccagagccaatcaccgtcaccgactcagcttcatgaagttctttctgctggtctaaataccggctgctatgggtcacatttggcagtgcagcatcaggcacatcgacaggaatcatcggtttgctccctgttccaagcacgacatgctttgcccgatactcagaaagcgatccatcctttaagcacctgactttcacaagataaccaccttgacagtccgtcacttcttctaccttcatgccaaattgacagctatctatttcacctgcgacccatgataaatactcattgaattctcttcgcggaatgtcaaactgttcaaatgtatagaaccggtgaagtctattggattcatgtaaataatttaaaaatgtatatctgctccttggattcgccatcgtcacaagatcagctaaaaaggagacttgtaaatccgttcctttgatcagcataccaggatgccaggcaaattcagactcctgttcaaaaaaacagcatgaaacatcttcatactcctctaacaaagccgccaaacctaaattggcaggtccaatcccaattccgatcacatcaatcatatgtacacctgctttaactttttatcacttatatacccttttacaaatgaaaaaaacactacgtcaccgcagtgtttaaacgtgaggaacaaataatgactcaagaaattgaattttctcttcagtatagtgttcataacggtcattatatgattttggatcttttggattggcatattgcgtaatttttcctgaacgtggatcaatgaatttactagcagcaccgcatccaatcccaatgattgtctgcacttcttccataataatgatattatacaaactttcctgtccatctaatgaatacccgacattttcaaggttccctaagatgtttttttgtctatataaataataaggatgatagtcatgtgctttcgtccaagcgaccgcttcatccatcatacgtgtgatttcttctcggtcagctacttgatatttgtccttattgcgcgtcatctcagacgctcttttaaaggagagcgtatgcacagttaaagattcaggcttaagttcttcagtctgctgcaaggaatgctggaattcctttagcccttctcccggcaaaccaataattaagtccatattaatgttattcatgccatactgtcttgataagtgatacttttcaatcgtttcttctacactatggtgacggccaatggctttcagtgtttcattctcatacgattgtggattgatactaatccggtcaatatgatatcggtttagcacctctagcttatcaggcgaaatcgtatcaggacgccctgcttcgacagtcacttcccgtatatgtttcacatcagggaatgagcggtacatttcttcatacagtaaatccatttcttccgcagtgatacttgtcggcgtacctccgccaaagtaaacggtcgtcactttaatcccatgttcttttagccaagtaccgattttttgcatctcataatgcagaccaaacaaaaacgttcccactcttccagcttgtcctttaatcgcataagcaggaaacgtgcaataagcgcattttgttgggcagaaaggaataccaatataaatacttacctcctgctgaaggtcatacaggtcaggaatcgcttgaagctgacgatcgacaatctcctgcatcaaatcgattttttcatcatgaatcaaataatcacgctttaatgcggcatgcgcatcttcctttgtcataccatctctcagcatcttatgaagtaattttgtaggacgtatccctgtgagaatcccccacttttgcgtcattcctgtgtgctcctgaagcagatgtaaataaacagacagcactgtgtttttaatttgcttccagcgctccttgtcgttcaatccctctgggacgtctcgcgaaaaacgactagtgatgtctgtttcagcgatgtgaccagatgcctccaccgttccattttcttctttccagctaaactccatgactagtccatcatgcaattcatctggaccaaacagcacttcactatcttcttcaaataaattggctatattgacaagcgggcgatgaaatcgttcatctgacagccctttaattaaaattcgcatcgtatcacctttatcttcaaacttgtttcattttacaaaatctatgtaggaaaagcaatgactggaacagttgaaggccctgccatttcttgattgacaggaccttcgtctatattatcgcttaatatcgaattgatgtaaaaatccttctctttgctgcattctaaagtattctttgatcatataagcgactccctgttcatcgtgtgaacgtgtcacccaatcggctttacgtttaacagaatgaggtgcatttcccatcgcaacgcctaagccagccaattcgagcattggaatatcatctattccctgcccaatgaccaccgtatcttctaatgtcaaacctaaggctgaggtcaaaagagaaacccccgcttcttttgatacgcctttgcatacaatattcattttctcatcactaatccgaataagatcgacagatggaaaagcttgttgaatggttcggtgaatttcagcctgaagctctgcggttgaatacacttcaatcactggtgtactgaccggttcatccatcagcatatcacttagcgattcaacaaattgcacgggatagaaaattggatcagacggatgaatcaacgtctttcccatcagctgtgactgcgtttttttccggttgccaatcgagaatttttcatgcagcaagcgaacattacaatcaaagctttcaagaatttgcacaagattaaatgttttttcttccgttagtttcttcacatgaagcggctcatcgagtttattcgcgataaatgcaccactatgcgttacaagggttgtcgttggaatcttcaacgccttggcaattttttgtgcggaacgaaaatgccgattggtgacaagcgtcacgtaaaccccttttttctttacatattccacagcttcttttgtagcggaatggatttttccattggaacgaagtaacgttccatctatattgagtgcaagtagtttttttgacactgaggcatcccccttcttgatgactgtacttacgatgaggatatgccctagcttggtgctttagaacatgcagttgaaagagccctgtgtgttatgaatcttttgcaaataaaaaaagcctacccctaggcttttttttatgtatggtttggatgcgtcacaatgaggtgatgaagctccccatgatccccttatctttcacacaccaaagcattgcttatatcagatccccttatgctttgcgtttctcccagaagcgcttctctctcgtttggctaatcgccttaaatcccaagtgaaacgcacccaattgtcccatgagagcgcttatttgaaagcactttcaatataagtattatcgcagaatttatgagcttcgacaacctttttttgaaaagttggacagggaacatgtgaaataaaaaagggcgaatatcatcgcccttttcattaattttcttctggattcccataaagctcttcaagaggcttcatgatcactttatttaattctccgatgagaacactcacacgttgttctgcttccatcaactgagagattttatcgtgctgttgaacaagtgccactgttttttgtgcttgctccacttcttcttgtgtgatctcttgaccagtcatttgtttttgttgaaggtttacttgaatgtcacggaagttctcgaacattcttttagaggactcatccgcgttaacctcatcataaagattttttagagttgagtattcttcgctatgacgcaatgctttttcaaggtcatatgcaacatcataaacatttacagacatgttatgtctcctttctatccgttatcaccgatatgatcggcggacaccactccactataacaaactatggctttcgtttcacatatatacaacgaattcattaaaatttctctagtctgtcttaaaataacgtgacaaagattgcttggattgcgccgattaatccccctaaaaaaccacctaaaaacgtgatcatcttaagttcattgttggaaatgctaacgacaagctcctccatttttttaagcggaaacagttcaatctgctcacgaatgatatcttcaaacttgagctttgcgagcagtccctctaatgcatttgatgctgctttaatccccttatcgacaagcactggtgctaagtgtattttgagatcaaccgctactacgctgacataagatccaactggcttgtctaatatcagctttgtagagaagtgtgaaagcaattgctttttcacactataagcaagctccttcacattccatttatcatccagttcctgaagagaaaattgtttcaccttgtcccattcctgaacgagcaaatctgataaaaacctctttgtttctgcatttcttaaaaacttaatgatttcaggatgtacacggtcaattaagcttgaatttcctaaaaacatttgaaccataccgccaagcatgccgcgttcttttaagaaatcaccaatcatattgccaagcctcgctttaccttcttcactttcaaagtaatggatgcctctctttaaaatataatctgctgcatctggaatttttgacgaaattttgttttctacttctaatgggagtaactcagataacgtttgctcattatatttttttagcaatgaatcgagcttctgatcagaccaatgatgaatccattcatctgctttgacgtcagcatgtgatacaccgaatctttctaacaaagagagcattgtgatctccatgtcagcgcctttatcaatcaatcgatgaactgtatgcaagatctcctgcttagcctcagatgattcaaatcgcttttgaataccttctggcgtgagcaaatgctccataaccaagacgccaacctgcttggctacttcatctcttcttttaggaatgagccctggtgtaaaaggaagctgtttcccgaataagtaatacggcttataaggacgaaaaagcattttaatcgcaagatggtttgtcgctgctcctataacggcacctataacaatcataaagataaaggttgtgaatatattcaaagtcgtcatctacctttcaaacaatacccgatgtttattggtttaatctatacgtattatagttgttgtcatgtcctcaagcaaatgaagcatgctgctagacatatgatcaatcgatctgtcgtaatgataaagaagcgcaatctttatgtaaaatcatgaaaatgtgtttttctgctggtaaaaaaagaagttgaaaagaaggtgttttttaatgacatcaacattaggtattgtgacgctttcaccgaagtatgaagagggattcacacgtgggctagccaaagctgcccctgcttatggtttaaaggttgtccgttttacaccacttgatttaaagccggcttcaaatttaatacaaggtcaaacatatacgaatggtcaaggattcaccgcagcagaatttgaaattcctgacttgatttacgatcgatgcctttacaagcatgacgcacaatctaaaaaagcaaaaccaatcatggaatggctgaaaaagtatccgaaaacagattttttgaatacaggtatttcaaataaaatgatgctattcgagcagctccgccttctccctgctttacagccatacttacctgtctgctcattattaaaagagccatcagaccttctcagcatgttaagcaaagacggttattgtaaaatgcagccgctctctcaacaacatgcagcatctacttacttcattttcttaaaagacagcactttcactgttcagctaagtcccgaacaagtcatcacattttcgcgtccatcagatatagagcgctggtgcagaaagtatgtaggccgatatttccttcaattttttcagacgagtgatcaaaaagactttttattcaatgaaataaggattttcctgatgaaagattcacaaaatcagtggaatcgcatagggattcacacaaaatcacctacagaaaataatcatttaagcattacacaaaaatcagcatccatgataggctttgatcactatctaaacaccttgcagccgcacatcaaagagcttcttttagatgatattgcatccattcaagcatctctgctagcatatatagataaaaccctttccccttgctttgaattcgctgtagacttactccatacaagtgaaggcaggcttttcatatcaaatataagatcaaaaccagggcgatccgcttttttaaaagcttatcctgacaaggaaaatgaattgattcgtaccattcttgcacatgcacagtcgatgaagtcacaaccgaaggaggtttctcatgaacaaaaatcgttacatcatcgccactcatcccgcaagtgaaaaaacaattcatcttcccatccattttaaaaagcaggaggcgatctattctcttgctttaggttctcgtctagtagatgacttcaccgtttcctatcatcaacatccaactaaaattttattatcagaagatctatatagagatttattcattccttatcaatcaaaagctgatgtgatagccattgatcataccctgttcatagggccactgcttggtattttcaccgcaggttttgagcaaagcacgcagccactaggaacgagatcagacttttttatcaaactgctgcgctctttcaaacagcatgccggttttgcttatctttttgggacacattctattgattgggataaaggaatagtagaaggattgttgtaccaacagcaaacatgggttaaaaaacaaatgcccctgccttcagtcatttacgatcgtcttccaaatagaaaggctgctcagtcagcattcattcaagaaacaaagcgcaaactcactcaagactatgatattccttggttcaaccctcatttttttaataaatgggacattcatgaacaattgttaacagatgaaaaaacatgtccttttcttccacattccatacaattggacccggtggacactctaaataaaatagaaacactcctccatctacatcaggtcatttacttaaaaccgtcgaacggcagtcatggcgacggtatttatcaattaaacaagaaggctcatggaatcactgtatgctcaaatcaaggaagggctgttccatatgactctttagaggatttcgttatcaatctccggaaagatcacgcaattcaagattttatggctcaacaaggcattgcacttcttcaaatagacaatcaaccaatggatttcagagttcataccaataaaaataagtacggtcattggacagtcacagcagtagcagcaaaaatttctggcaatcacaccgtcacgactcaccattcacatggaggctcggtgaaaacactttatgatgtttttccagaaaagaagaagcgtttgaaaatcttagagcagctttcttatactgctatcacgcttagtcaggtaattgatgaaaaattgtccggtcatattggtgaaatcggttttgatttaggtattgatcggacaggagctatctggatgtttgaagccaattctcgccctggccgagaggttttccagcatgtctcattgcgaaactcagaaaggctgattggaaaaagaatcatggattacgcctcttacctttcacaaacgaccttaacaactacagaccacacaaacatctattgacaggtttttaaaaaagtaagggtgtgatgaaatctatgcttttcctatgctcttttcatcagatgagatacaataaaatcaagttcaagattgtttccgtattgtcgtgtttatttattgtttcatcaataaaagcaaggaggcaatgatgatatgatttctcattttcaatggaaacctctctttaaaaaagcacaattgccaggctggaaaatatccttttttcacaatggtgcgcactacgaaggcatctaccacaaaacaggtgatattgaatggggctctcagcttccgcctcatgaaatcgaaccaaccttaaaagaagaaatccacgaattaatgctattccatgtctatgattaaactgtttaaggagcttcgccatgttagaaaaattaaagcttgtttacggagagcatatcatcagctcccctacagatgatcatcaaatactttggtaccaaacagacgaaggcgaattatttggagtagacaaatcaaagcttacagctagagaaacacatcttctcaatactttccttacaccaattgatctttctcacacaaagcggactgaggatgaacaacaatggtacagctatctttttgataacaagccactaaccgttcagcaccccgtccgtgtatattattttaaaatgtcacatcaagcagaacaaaggcagcaaataaaagaggctgtggttcacagcctcgaacaaactcatttcatttggacaggcgctcatacagcgatgctgattcaaacaaacgctacatcagaaaatagtcaattagagctgctatatgatttgtctctagccattacaagtgactttttaacagactcattctttttacaaggacaacttcatttgccaaatgaacatttacagaagaaattgttaaatgaacagcagcttgtctttggtcatatgcagcgaggtaagcttaggtcagggatttccacattttatcaatgtctgccatcacttttgcgttatgatgaaaccgccctctctcatgctatttcagatgcttttaaagaggcggttcttgatcgggacgtttaccgtaccctcatgacttatatgcaatgtaacttaaatgcatctaaggcagcaaaagctttatatgttcacagaaacagccttcaatatcgaatcgataaatttattgagcgaacaggaatagatatacgacattttccagaagcatctgctgtttattttataatgaaccttctcgatatttcataacattccgtgacatgagcaacctgcccaaaaatgaaaatgagatgttgtgcacgttgtccatttacagacgcttccccattttatacactttatgtacaatataaagcgctttcaataaaaggatggggaggttatcatttatggctgaaatgatgctcaatcaaatttataaagtgtatgataacaaggtaacagcagtagacaactttaatctacatatagaagataaagaatttattgtgtttgttggtccatctggatgcggaaaatcaacaacccttcgcatgattgcaggacttgaagagatttcacaaggggattttcttttagacggcaaacggatgaacgatgtagcaccaaaagaccgagatatcgcaatggttttccaaaactatgcattataccctcatatgaatgtatacgataatatggcttttggattaaagctgcggaagttcccgaaagcagaaattgatgagcgggttcgaaatgccgctaaaatattaggccttgagcaatatttagacaggaaaccaaaagcactgtctggcggtcaaaggcagcgtgttgcacttgggagagcaattgtgcgtgatgcaaaggtctttcttttggatgagccgctttctaatttagatgcaaaacttcgcgttcaaatgcgtgctgaaatatctaagcttcatcagcgtctgcaaacgacatttatctatgtcacacatgaccagactgaagctatgacaatggctactcgtcttgttgtaatgaaagatggctttattcagcaggttggagcgccgaaggatgtatatgaaaatccagaaaatgtatttgtgggtggattcattggctctcctgcgatgaatttttttacaggaaagctctctgacggtgccattgcagttggaaaaacgcatatacgtgtaccagaaggaaagatgaaggtattacggagccaaggttatataggaaaaaatatcatccttgggatcagaccagaagattttcatgatgaacccgtgtttatagaagcgtctgagggtacaaagatcgatgcccacgtagaagttgctgaattaatgggagcagaaacgatgctttactcttctctcgatggtcagtcttttattgcacgtgttgattctcgtaccgatgttcaggccggacaaactatacctcttgccatcgatatgaataaagcccacttctttgactcagatacggagctccgcattcgttccgctgaataaatatatatgcagtgccatcactcaatcatgagtgatggcttttttgcatgttgaacaacatttaccatgttcttttctcgtatgtttttttcgaaaatcaccataatacttagtacaaagcagttaccgcattgggtttcgccaagtggcaaatgacttgatcatttcgctggtgcgattccagcaaacccaaccataaaaaaatcacatacaaaaaggagattcacatcatggctaattctaatagttcaaatcaattactagttcctggagcagagcaagcaatcgatcaaatgaaatacgaaatcgcttctgaatttggcgttaaccttggagcagaaaccacagctcgtgctaacggttcagttggtggagaaatcacaaaacgtcttgtgtcttacgctcaacaacacatgggtggaacaaaagcttaatttcatatctggatcatagaaggcacctcttaaggtgtcttctttttttgttgttatccctcaccaatctcctttccagctcatatcatggagtagaaaggagcggatcttcatggacattatttccggtatgaactttgaacttctacaattcgtcggtatctctctattatgtgaatatgctcatagtattcggtcctttcatctttataaaaaaagcatcacataaaagttgtaccattttgggttcttttcacttatagtatgtagtggagggatcgaatagatgaaaatagctcttttcggtgctcatggacgtgtaggacaagcatttcttcgtttcgttcaagtagatgatcgttacatcgttcgttcattgattcggacaaaccgagaagaaatgcttgcgggtatgtttcaagtcaccggcaattcaagaaatctagaagatgtgcttgagacgatcaaaggagcagatattgttgtgagctgtctatccacagatggtgatgatacattatctgtttcaatggagcatatcgtacaagccatgaagcaatcaaatacatcaagaattattacaataggtacggcaggtattttaaaggcaaggcagcagccggagcattaccgttttgaaacaaatgaatcaaggcggaccacttcccgagcagctaaagagcatgccaaagcgtttgaactccttcaatcgactgatttagattggaccattatttgtccaacctatttaccagacggagaagtgacacggtcatatcgctatgagaaagattttctccctatagatggaaagaaaatttcagttgaagataccgcacactttttatatcagcagttaaattcgaaggaatttgtacatcaacgtgtcggtattgcttactaatgacgcataatgagtaaagatcgaggtcaaaaacgatcgctcgacttttttatgcaaataaaaagagcccattcaatatgaataggctctttttgtgattcatcagctgtttgccacagcacccttttgcagttcgtacatttgcgcatatagcccttcttgctgcatgagttgatcatgactgccccgctcgacaatttcccctttttctaaaaccaaaatcatatcggctttcttaatggtggataatcggtgagcaatgacaaaagtggttcgtccttctttgacgacatcaagcgctcgctgaatgatcgcttctgtttctgtatcaatgtttgcggtggcttcatctaaaattaagatcgctggattgtatgctagtgcacgagcaaatgaaatgagctgacgttcccctgaggaaagagtacttcccttttcaacgactggttcatcaaatccttctggcaggtgcttcaataactctactgcgcctacttgttttaatgatgattcaatcgtttctcttttaatgtcttcatttcctaagctgacattggatgcaatcgttccggaaaataaatacgggtcttgaagcacaatgcccatttgtttccgcaacgtttgccgggactggcgataaatgctttccccatcaatgagaatgtctccttgctgaatgtcataaaaacgcagcagcaagttcataatcgagcttttcccagaaccagtatgccccacaagtgcaatcgtctggccttttttggcctcgaatgtaatgttctttaatacattttttccttcattataagcaaaggtgacgtcttggaactgaacgtgcccttccatttccttctgaacaggttcttccactgttgttcctggctcatctaataatcggaaaaccctttccgatgaaacccgtgctaattccaatctcgagaattggttcacaatgcctgtaatcggctgaaataatcgatttaggtaatcgacaaacgcatagagcacaccaatcgacacaattcccgtcgcacttaaagaggcaccgccaaaataccaaatgagtgccacgtaggctaaattccgaagcaggttaaccaagttatgcgacagaagtgaatttaaatgaagcatctttcgctgatatcgaaagtgattgttgttcagctcatcgaattcctcttttgtcactttttcatgacgaaacgcttgaataatggtcatcccttgaatggcttcatttagcttggcattgatgtcactaatgatcgaacgaatgcggtggttgtataccgatgcaaattttctgtaggtcattgaccataggaaaataatcggtaccgccaccaaacaaataagtgccagcttcacatttaataaaaacatggcaatataaatcccaatcatataaatcgcactcgtcacaaaattggcgaggactgtcacatataaatcacgaatggtttcagtgtcattggtaatcctcgctacaacctttccagccggtaaattatcaaaataccggataggcagcgtttgaatatgttcaaacacatctactctcattttttgaataattcggttggctattcgctgtaacaggtaatgctgcgcatattgaaagaaaatcgcaatgacgagaagccctagataaaatagaacaagctgcaccaaaccactgatttccggctcataaaaagagaaaatttcctcttttgataaaggctgtacttgataggtctcgcgctcgtttccattttcaatggtaagttgatctcccgatatttttcggtttccgtcaaagcgaatcgtatcatttacaaaatagtaaccgaagccgacttgcaccacattgatttgttttccggattccatctcactgtctaatcgatcgcttcgtatatagttatttccctggtaataaacggttttgtctgttttttcattgacctcgacatatggcttttctacacctaaaatatgatcatcaatcattttcttcccaataaatggtcctgtcagttcagcacctactgcaatgatgagaaagatcaaggcaacagacagtacttttttataaaggagtgcgtaggcgaggagtcttcttcccgttgtcatgcctcatcccctccttccagctggtttgtcagctgttgacgcagaaattgttctttgtaccacccatcttgctgaatgagctcttcgtgagttcccttttggacgatgcgtccttcttccatgacaagtataagatctgcatgctcaacagctgatagacgatgagtcgtaataaacgtcgttttcccatgacgattttgccttaaattttctaaaatagcggtttctgtttttgcatctaccgcagaaagcgagtcatccagtattaaaatgtcgggatctattaataaagcgcgcgcaatggaaattctctgcttttgtccacctgacagcgccacacctttttctccgaccatcgtttcgagaccctctggcaaaagacgtaaatctttttcaaaataagcatctttgattgcttgtgctaattcattttgttttgcgtctcgatgaccaaaacgcatattctcttctacactttttgaaaagagaatatgatcctgcggcacgtatccaatccattgaaatagctgatccaattcgatctcttggattgggattcctgatagcaggatgtgaccatcacctgttggatactggcgcagaagctgttttacaatagttgttttaccgcttcctgttttgcctgtaattccgatcgtctgcccctttcgaaccgtaaaggacacatcaattaaattatcttttggggaagttggatacctaaatgtcacgtggtcaaactgaatatcgccaggctcttgtaacgtttttggctgagaagcatctgtaacatccggcttatagctgagtgtatgattcaaccggtctaacgacgcatttcctctttgcataatattaatcaactcgccgatcgcaaacattggccagatcatcatcccaagatatacgttaaaagcgacaagctcaccaatggttaaatcgctttggaatacaaggtaggcaccgtatccaattcctattaagtagctgaccccgacaagtaatttcactgtcggctcaaacaatgaatcaatgaccgctactctcatatttttttgaaatacatcatctgtcatttggcgaaagcgttcgacatcttgtttctcctgtacaaaagaccggatgacccggacacctgcgaccgattcaaggacgcgatcattcatatcaccaaatgcatcttgagcaactgtaaagcgatcatgaattttgctgccataatacgcaatcaagagcgccatcagcggcataggaatgatcgccattaaagttaatttccagctaatcgtcagacccatcgtaaaaaagatcatcagcatataagcagtggaatccaccaatgtcagaacgccaaaacctgtcgttaaagctacagcattcaaatcgtttgtacctaatgccattaagttaccggtttttttcttttcataaaaggtgggtgtcatcttgagtaagtgacgcataagtttcccgcgcatcacacgttccatgacatttgcgccgccaaataactgatacatccagaaatatgtcagtgtatagacaacgacacctagcaagcaaaaaatggctacataaaacatcatactagatgttgtaaattgaccagaacgaatgtcatcaactgcctgcccaagatatcttggcggcagcatttcaagcacattcacaatgagcaggagcgtaatggcgatcgtataacgcctccactcttgtttgaagaaccagcctaatttcgtaaatactgaaaacatgtttgtctctccttttaaagctagccgctttctatattttcttggctgtcaccttgaattgtttttttgttttttgtcatttgtcttgtttttggcatgttcacatgctttcactcctcttcatttacttgttgatctccatcccttatttcgaaatacgaaatgaatacaacaaaaaaagaggcaaccagctatctggtacgcctcttttcgtcatgtaaaaaggcgcatgttgacaaatacgcaacatacgccttgattcatccgatcaattggaacatacgagtcccttttcaatgaccaatgaaggtgtaattgtcacgtgaatcaacccattcatgcagtttgatttcattcttccaatgatgttgcacatgacatttcctccttttggctcttgaatctttttttatcttatagtggctgtcaccattttgtcaataaatatttttcaataaatgaaattttctaacaaaaagttcacaccctttatgtgtatctttttcagttaacgggtataccatgagtgtaaagactccttttgaaaggaatgaggacattgtttcaagctgatcggatggtcgttgcgtttgatggacatgaagacagtaagaaagcattaaaaaaggcaatcgctttagcgaaaaccttgcaggccaagctgaccgttgcctatgcatatgatggcaaatcaagcagacaggtgtttgatgcacctcgcccaatgactggcggtgcttacatcggcggcggcatggcagaccttcaaacgccccctgtgtatgtacctcatgatgaacagcaaagtcccttgatttttgaagaccatacagaagaggtcgttgcagaagcaagaatgcttttaaatgaggagcagtttgaggctgccattgaaattgttgagggagaaccagcagaagcgattatcgaatatgctgaagacatttcagcagacctcattgtcatgggagcccgtgaccaaagcagattgaaaaagatgctctttggcagtgtaagtgaaaaattatcatcaaaatcagatatacctgtgcttattgtcaaataaaagaattacaaaaggctgtaaacattcgtttacagcctctttttattatgaagaaatcgatgcttcactttcctgtttaattttttgctgaaagccttcctgtacacgctttgtcaactctcctggaacgccttcccctactggctggccatcaatttcaacaatcggaatgacttcagccgtcgtcgagctgatgaaaatttcctgcgcgcgcagcagctcttccttacttatacgcgtttcttcaacactgcatccctcttcttcacatacttcaagaagctttctacgggtaataccgtttagaataaaattgtttgcgggatgtgtgcgaatcacgccatcaatgacggcatatacattcgaggaggtaccctctgtcacaaaaccatccctaatgagaatggcttcaaacgcaccagcttcagatgctttctgtttttccatgacgttatataagagatttaagcttttaatatcacatcttaaccagcgaaggtcctcagatattatggcctttgcaccagctgtctgctcttgaacaggccttttcacttggaacgtatatgctgtgatttgaggagtgagagaatcgccatattgatgtttacgaggtgcgatgccccgcgtgacttgaatatacacaccaccatctgttaattggttatgggcgacgagctgttttaacttttcttccatatctgatactgcaccttgaagatgaatgccgatttcttttgcactcttgaacagacgctctgtatgctctttcaatgtaaacaaagtcccattgtatacacggataacctcatagacaccgtctccaaattgataacctctgtcttcaatatccacatgagcatcctttttttcaatgaaatcgtcattatacaatactttcatacggaatctccccttcgcttcgcattaatggttgaatctgatgctatcttagcggataaatgggtatgtttcaatgattattcagaattatttcacatcatgataaatggtcaactttctattgtaacaaagatagactcataaccaaaaagattccaattttttagcatcttctatattcataggctcttttttcctgtatacttactccatataaacacgacaaaaaacagtgaaaaaagacagaatctactacatgattcgacacaaatttttgatttattggagcgattgtaatgcaacgggttacgaaaaaacagacaccttcaaacacgatgctgctctcaaaggcgattggtttagtgattctgtcactgatcctcttttttatttgggatatatctaaaaccaatatgcaggcagcagaccagccgactaaaatgtctgcaagcagtcaattccgagacacaagcacaagtctgaaagcaaaagatgattctacgaaaacattagatgcacattttaagatcaacccaaacaaacacgtaacggatcaaacgatctttttaacctttgatgatggtccgtcagcgacatcaaaccagcttttagatgtgctcaaggcgcatcaagtaaaggctacattcttcatgcttgggccgcagattaaggaacatccggccgctgtgaaaagacttcatcaagaaggtcatcagttagggcttcatgggatcacacacgatgtgaaacgcttttatcaaaaaagtgattctcccatcaatgagatgaaagaagatcagcgcattttggcttctgtcacaggagagtatacacaccttgtgagaacaccttatggcagcgccccaaatttaaccgatcaacaaaaagcacgtttaaaacaaaaaggctttatctactgggattggacaattgacagtcttgactggaaatataaaagctcaaaatatgtaccagaagtattgaatcagctgcaagtgctagagacaaaacatccaaaggaaccaaagatcatcttaatgcacgaccagccagcgacagcaaaatacttaaacagtttgctcacacagctaaaagcgaagggctatacttttgaagttcttgatgaaacaatgacgccgctgcagcaataaagagaacccgcacctattagatgcgggttttttgatgatttatatagctttcacgagatcaccaattcgctcatgaaagacaagatcaaacagtggatcgtattctgtttcactcaaattcatcatcaccttgaagatggaaggattttgagcggcatcttctggaatatatcttgctggcgctacttctagggaggttcccatgacgagcagaaggtccgcttgctgaagtgatttctctacttgatcaaaatgtttaaccctgtctccaaaaaggacaacatctgttttcagcacttgcccacatgtccgtccgtctgaggaaacctttagacatacaggcacttcttcttgtaataaataaggcagttcatatgtcgcttggcatgatgggcaagtagctgtttgaatagagccgtgaagttcatatacatgctggcttcctgcttttttatgcagaccatcaatattttgggtaaaaatctctacatgttttccttgtttctcaaggctggctaaaaaggtatgcccgctattcggctcgtacttcccgctcattttcatctgaaacaattccttgaatttcggccagaattgatgagggtttgataaaaagtaggaccggctcatcgcttccatgcgagcggtgtcttcagtccataagccgcccgttgatctaaaatcgggaatacctgattccgtgctcatgcccgcacctgaaagtaccattatatgtgaagcctgcgttaatttctctcttagcactgccacctttgtttgatccactcatccttcctcctttattcactcagctgtttttcacctttttgtttcatgtaaatggtctgtccagggaaggcaaattctacaccttcttcatggaagatatccatgatccggtagttaatgtcctgtttgatatttaggttttcagcccaggccgtcgtgtttgtgtaaaagttgaaaaataaattcaaataactgtctgccagtacatcgagattcaccatgattgtctccttgtgcaccccatcatgctcataaagcatttgtttgagtcgtttgatacaatggtccagattttcctttggtgtattgtaggatacacgtacggaaaacgttatttggcgtttattcattctcgtccagttcgtgattggttcctttgaaagcgtagaattcggaactgtcacgactgcttcagcaggtgttctaaattttgtacttcgaaatgtaatgtcctcgacagtccccagaacacttggcgtctccacaaagtcgcccattgtaaaaggcttctctgtaatgatgacgattcctccaaaaaagttcgccaccgtatcctgtgcagcaagcgcaaaggctagcccccctagaccaagaccagccacaagtccatttacatcataattaaattcctgtgcaatcacactaatacttagtgcaatgataatgaaacgaagcaccttcgataaaaatggcgctaaaatatcatccatttctaattcaaatttcgaatttactttttgaaataagaaagaagaagctgcggttaaattacaaagcccccatgtcagcatcaatataatagaggatctatataatttgacgatgacatccatatgatgctcaaagtatggtgcctgtcttaacgcaaaatataacccaagtgcgacaaaaaacagtctggctggcttttcgaatgccacaacaatttggttaatgacctccgttttagaccgattggtcagcctaaagagaagatgaaataagtacttcgtaaatactttccgaagcaataaaaaaagcaataaaatacaaaggctaatgccgatttggatcgcaacatctactgtaaaatatgtatccatccatttttgtgtaaacatgtttgtctctctcctttaaaacaatcctctctagtttataatataaccttcgtttatgtcctctcataaatgtctgacctctaaataaaaagcctcgggaccagtcccgaggcatgatgttcaattatgaaattttggctagagacatatcgacgggcagcaaactactttttcttctgagcctgatcaaggagagtcgctttaaacatttcagcatccgtttcgaccttaatacgttcttccactctaattctccctttacccaatcatctcgcctccttttcatcattataaaacatcagaattttcagtcaacatgacgaaagcactaatattttggcgaacgctgacgatttggacaaaattgatcgaagaaaaaattgatgtacttcagatttactcaatcatggcttgggatattcctgtaacttttcatatttgaaacctcatactttctcggcacatgccgttcacccttacatactgctcttcttccctccatatagtaaagaaggaaaaacgggaaagcatttgatatgataagaccagaacttacgtcagggagctggagcatatgtatattatcgcgcatagagggtcatcaagcgctgccccagaaaatacaatcgctgcgtttgatttagctgttcagcagggtgcagattatattgaattagatgtacagctcacaatggaccagcacgtcgtcgtgatccatgatgatacagttgaccgaacgacgaacggaaacggcttcgtcaaaagctatacacttgatcagctgaaaaaactggacgcaggaagctggtttgaccaacagtacacgaatgaacgaattccgacattacaagaaattcttgaaagatacagtcagcggattgggatattgatcgagatcaaacatccaaaacggcagataggaattgaaaaggcagttgccgacatcatcaatcgttttgcctattctcgtcacatcatgattcaatcttttgatgatcatgcactgcaaagaatcaaagcattcgccccttctcttcgaacagctttgattataaagcctaatgcatttaaactgacgaaaagaaagttaacggcatacagctcgtttgcaaattgtcttaatatgaagaaaacgatgatcaataaatggtggatagaccgcatccacgcattcgggatggatgtgtttatatggactgtgaaagatcaaaaaacagctgatcggatcaaaaaatatcccgttgatggtgtcgtgacggatcacccgccattttttctaaaggagaaatgatgtaaatgaaagcatatcttgccgtatttattggcggactgattgggacactttgcagatatgaactgagccaaactgttgtcagccaaacattcccctatgcaacgctaattgaaaacgtgacaggcagtctgcttcttggtttttcaacaggatattttatgttccataagagaaaaaaatatcttgccgctttgatcggaacaggattttgcggaggttttacgacaatgtccactttttcaaaagaaacgattcttttattacagactgggcagttcacttcaagtgtgatctacaccctgctctcagtcattgccggagtagccgctgccttatgtggactaatgttagctcagcggctctttcatcaaaataagcagcagagaggaggcagataaatgatcattttatatacagctattgccggcgggatcggcagcgcccttcgttttttcattagccaaacgatacagaaatctaagtctcatgctcgtttcccatacagtattattctcatcaacttattaggtgctgccggtttaggtatactgacaggtgccgtgactgccaatcatccgctgcttatgatcattggaacaggttttttcggtggctttacaacattctctacatttagtgtagaatctgcaaccatgctagagcagcggcaaatcggaaaacttgctgtctacttattgatgacaatcatcgggtctttctgtctcttttctgcgttctatcaaataagacaacaccttttttaaatattggtaatagcggctaagctgataagcagttgatccataagctggcgcttcattaaaaagagggttttttcactgtagccgatttccatcgcacacttggccatacgccaatcacgaaagtatttgtaatcgatgagctgcttctctatctcatccaactcttttagtgctgtatcaacacacgcaacgatgagttcatactgatttttttgctcttctaacttcttccgtgtcatgtgatccaaatgatgcgtacttcttttttcaagctgtctttcgatatttaaaatcgccgcctggtaatttttgaagttcttcaaatgaaactcaattcgtttcattgagttttttttctccgtgatacttgctgtttcataccaaagcatgttcatccccctcatatcgaacgtttgttctcattataacccgaacaagtattcgtaaaaagagactaaatacccaaaaaaaccttgagcttatttttcgctcaaggtcatttcgtttactaacagcggctcttttatatcacgccctatgcgtgcatttcctttttctgatgaggtgacgcctttcttcaggtcgatctttttcacatagcgtccatccatctccaagaccttcatccgaatatcatcaagataaatggattgtccttctcggatatcaatattctcatttaagattaacccgcctattgtatcaatttcttcatcatgatatgacattccgatcaaatcttgaatttcatctaatctgactttgccatctaaaacataatgatgatcggctcttttttgaataaccggctgctcatcttcatcgaactcatctcgaatatcgccaacaatctcttctaatatatcttctgttgtaacaagtccagacgttccaccatattcgtcggttaaaatcgccatatgcattcgatcgcgctgcattttgacgagaagctcctgaataggaatcgtgtcaatgacctcaatcactggatatatataatcttgaatcttcaattgatccttttctacttgatacacaagatctgcaaagagctgctttttgttcagcatgccgatgacatggtctttatcgcctgaaaacacaggaaagcgtgtatacttctcctgcgtcatgatggagagaatctcatctagcggcatatcttctggaatggcacaaatttctctccgcgggaccatgatctctctggcaattcgattatcaaagtcgaaaattttgttcatataattatattctgatgggttgatttccccattttttaagctctcagataataaaatctttaattcttcctcagaatgggaatgttctttttcagaccccatatcgatgcccatcattttggttagaacccgagctgacccgtttaacacataaatgaaagggaacattaggatataaaatgcatgcagcgggcctgacagccagagcgtcattttttccgccttttgaatcgccaatgtttttggtgcaagctcaccgacgactacatgcaaaaaggtaataatagagaacgcaagtgttgctgagatcaggctgattgctgaatcaggaatgtttgtcaaaccgaaacctcgaaccaaaagttcttttacagctggcttaccaatccaccctaaaccaagggatgtcactgtaataccgagctgacaggctgacaaatattcatccagccttgatgtcacctttttcgccacgatggcctttttggacccttcggcaacaagctgatcaattcttgagcttctcacctttactatggcaaattcagatgcaacaaagaaagctgttaaagcaatcaaaacaccgactatactcagattaacaatatcgtccatttaaccttgctctttctcagaagaacaaggagtcacctcctgattgatgatgttatgttttgcaaaacggttaactgattaaataagactatattgagggccccacttaaccacctccggttcacgtataaatccgcttctctacatatatatgaaacggtcttcattttatcttaccataaataatctgaaaattcctgtatcactatgtgaaatttgacaggaccatttagactgagaaatccctctctcctcttcatatcggcaagaaatatgaacaattaacttgtatttcagactagaattatattaaactattttcataaactataacgtgacggttaggaggagatgttcagatggggctgagaaaaagtatcgtattggtgaactagcacagattgcacaggtgacgaaacgtactgtagattattatacaaatctagggttgcttgcgcctgttagatcttgctcaaattatcgttattacgatgaacatgctttaaaacgattacaattaatcgttctttgcaaacagcagagattggctctttctgacatcaaatccagattagatgaacaattcccttctcaaaaggaagatcctgatgaacttgtccatttaacctctgatatcgatcggatgaacgaatatatggaccgcattttagtacgttgtaagcagcttcaaccagaacaacgtgaaaaattaaaagagcagcttacacctgaaaagatgacggctgtccaatcatttttactgctgttaagttaaaatttttactatacaggaggtgttaccttcgttctcaaagtcagaacgaaggccttaattggacatagttaatttacttatagttgctttgcttatagctttaaccgcatttttcgttgcatcagagtttgcgatcattcgcttaagaagctcaagaattgatcagttaatcgcagaaggtaataaaacagcagttgctgtcaagcatgtcacgactcaccttgatgagtatctgtcagcctgtcagctcggtattaccattaccgcccttggtattggttggttaggggaagaaacaattgcgcacatgcttgctccactatttgtagagctgtccattcctcaatcagctagttctattgtcacttttattattgcgtttagtattatgacgtttttacacgttgtggttggagaacttgcaccaaaaacactcgccattcaaaaggcagagcaagtatctcttctttttgctagacccctcatgattttttacaaagtgatgttcccgtttatctgggtattaaatggatctgctcgtttgttaacaaaagcgttcggtcttcagcaagtttctgagcatgacatggcgcactctgaagaagaattgcggattattttatcagagagctataaaagcggcgaaattaaccagtctgaattcaaatatgtaaataaaatttttgaatttgatgaccgtctggcgaaagaaattatgattcctcgtaccgaagttgtcagcttccctcatgatattaccattgaggaaatgctgaaggtgaccaaggtagagaaatatacacgttatccaattgaagatggcgataaagataatatgattggtgttctgaacattaaagaggttctcactgcctgcattagcggtgagtgttctacaagtgatacaatcgaaaagtttgtcaatccaattattcatgtaattgaaaccgttcctgtacatgatctattgctcaaaatgcagcgcgaacgtgtacacatggcgattttatcagatgaatacggcggtacagctggtcttgtgactgtagaagacatccttgaagaaatcgtcggtgaaattcgtgatgaattcgatatggatgaaatcaacgaagtgcgtaaacttggagaagaccattacatctttgatggaaaggtcctagttgatcaagtcaacctgctcttaggtacgcagcttgataacgaagaagtcgatacgatcggcggctggttccttactcagaaatatgaagttgagaaaaatgacaccattcgtgaacaaggctatgaatttatcattaatgaagtcgatggacaccatgtggtatatatcgaagtcaaaaagttaaatgaacaattagcagaagccgctgaagaaggcgcttcttaagaaaaaaacgacccttgccaaagcaagcggtcgtttttcttatcctttttccattaattgagcttcaagttctttaattctcgtgtttaatacttcagtcatggcacctaaacgttcttttggcggcagatgctcaaattctgactgctcaatcggttcaccaataattaagcgcattttcccctttttgaaaagacttttcgcattggacggccctttgtacgctgctggaacgattggcgctttaccgagctgcgcaatggtaaccgcacctctttttaaaggtacatcctctgttgtacgtgttccgcttggaaaaatcccaacgatctttccctcttttaataatttaatgggcgttttaatactgcttggcccaggattctctcgatcaactggaaaggcatgaatcttctttaaaaatccaccgatccatttgtttgcaaacaattcttttttcgccatgtagtggatctcaaacggaagaatccctgcgcctaatgcaagaacatccacaaaaccctcatgtgtacatgcaatgacaaatccccgatctgttggcagattctctttttgatatactttgattccgcctcggagagtaaataatactttaatggtatagcctgaaaatttatacataatgcacttcctttgtttgaaaaatgaaggatttgtttctattataacaaattttttattacctggtactaatttttttgaaacaatcaaaccatcacatcatttttcgttcagaatcatcgttctttctgtattcaggtctatggttttaggagagaatagaagaagaattgtgtccaattttgtcgttttttaaggttttttcctgatttgttctattgaaaatgctttataaatggcgcaaatttcgctatgataaggagaaatgattttgattcggcgaaagagatgagtattgtacggtattgagaagtttcgtgcaactttatgcctttcttatgcgtttataacatagaggggagaaaaatcagtgacgatcgatgaaatttatcaaatgtatatgaacgatgtttacaggtttctgctctccatgacaaaagacaaacatttggcagaagacttattgcaggaaacctttatgcgtgcttatatacatattcattcctacgaccatagcaaagtgaaaccttggttatttcaggtggcacgaaatgcttttattgattatgtcaggaaacataaaaaagaagtgaccatatcggatgatcttattggcggccttttacaaacgtctgtacaaagccctgctgaacaggttgaaataaaagaagtcctcaacatgtatttggaacagcttccagataactacaaggaagcgttgacattgtattatttaaaagaactgaattacaaggaagcatccaaggtcatgaatattactgaagcaaattttaaaagtgttttatttcgtgcaaggcagcgcctaaaagcactatataacagaggtgttaatgatgaatgaagagtttaacaagcgatgggaacaatataataatggtgagatgaacgaggaagaaatgatggcgtttgaagaagagcttgaagaaaacgaaaaacgcttaagtcaggaactgaacgactcggattggaccgatttttccatcagtcctgaaaagcaaaaagccatcttgcaatacggaaaaagaaagtcttatttacgtatttctgtacttgctgtcatctctacacttattattttaccgctttgtacattaggaagttatctatattacggcgttggcggagcagagagcaaagggaatcatttcatggaaacagccgctgtaacagtcgctttgacgaaaccaaacgtggcaattgaaatgaaagatttaaaaggccaagtcaagctttttggaatgaacacagaactgaagctgcaaaaacaaattggcaataaaacagaagccattggcagtgagcaaatcgagatgttcttcgataaattaaagcagcctacgatctcatattatggtgacagcgcacgcgagacagaggatttctttacccatccttctactcaggcagatgcatcaaaaaaacaaacactcactactttagacaagcttcctgaaggaacagtcagtgaagtgtatgtctcctatgacaaagcgtatataccaaaggacgtttattcctttgctaaaaaatatgatatgaaagtgctctggaatgcgattaaaacagaggattcattaagcgggaatcagcggccaattggctttcctgggagagactctgaattcttaaaagagcttcagcacacatcaaaaacagaggtagatcaatttaaagatgcccttgcttatgtcaatcagcacccaacctgggcaaaaacgatctctggcagacctgaattggatctgtcaaaccgaatacgctatatcaaccaaaatggtgtcacgatttatggctctgtgatcacaggtccttcgaaagaaatcgagaaatttgtgaagacaaaacgcattaaaacggcaaaagtgagcgaggtggaattatggaattggtaagaatttttaaagagcataatgtatttggctggatttctgtcggtacagcgatattatccctgctcatgctgaacctcgccattatcagtaatgtgacattttattcttttcagatgctcccttttgcaatggccgcagttccatttggcattattgaactgttcattaaaaaaggccgtacgggccctgggttcctcggtgtcgtactgaatatctttgtcattttatgtgtctatgccatcgtatcgatcgatgtcgatcttcaattaggcttttaagccgttctcaaaatgaaaagcccgtgttacttgactaatcccaagtaacacgggctttttctatcgatttattttcttcattctacagcgcaaataaaaaagactgcttcataagcagtcttttaaaataaattagttcacaaatgttttcgctccaaggtaaatcggcttccagtagcttgaattcatatcactgatcgtcacaccatcggaagcagcatgaataaacttgttgttcccaatgtagacacccatgtgagatggacccgatttatatgttgtaaagaacacaaaatcgccaacctttggagaagatacgcttttcattgatccccagaaaccttcagttgtttgtcttgaaatctttttttgcttgttaatgatataccacataaatccactgcaatcaaagccctttggtgtcgttccaccccatctatatggtgtgccattgtacgctttagcatccgcaacaagcttagacgtgtttaaagaagaaacagaaactgttttttctttaacaggtgttgtctttacttttttagacgtctttttgacctttagcttttgcccaattttgatcaggtttgttttgagtttatttaacgatttcagctcttttacagtcatgccgtactttttgccgattttcgataatgtatcacctttcacaactttatgagtggctgtcgctgacgccgcttttacttttgttgttgtttttgatgttttcgttgtttttttagcggcagtaccatttacttttaacgtttgtccaacatatatcgtgttagatttcagcttattgtctgatttaatcttgctcacgcttgtcttatattttttcgctagaacagaaagagagtcacctttttgaacttttactgattgtgctgaggcagctccggcaaataatgtcgtcccaagtagaactgcacttgcagctgtgatcaattgttttttcatttgttcctcctgtatgtatctatcgtgatccgaatttttatctacttactattataaggatcaaataccagaagaaatagtcttgacttcctacgacattatgcttattaattcggcaaaatttatttttttttagggttctttatatttcattttcattacacaatcatgacaaaataaatgcatcttgtcatggataaatgatacattcatttctctttttggctcattctatgtaaagtggacctttacaattttaaagggatttttacgatcctgtaaatgggaatccacaattctgctctaccattgtaaacgtaagagcgatacataaacaatgaggaggcaaaatgaatgagtgtgttgaaaagctcgaaaacgaaaatcgctgcagtggcggcagcatctgtgctatcgattggcattttttcaggaattgaatttggacaagcggacaaagcagaggctaaaaagaagcccaaaaatgacgtgcaaaatgtgatcgtgctgatcggggatggcatgggaacaccgtacctttcaacttaccgttcatttaagcacaacggagacctttcaaaacaaacagcgtttgacccttacctcactggcatgcacaaaacatatcctaatgattcgaaaagcaatatcactgattctgccgcagctggtacagctatggcaactggtaaaaaaacttacaacaatgcaatcagtgtaaataaaaagggcaaaaaattaaaaacagttctagaagaagcaaaacggaagggaaaatctacgggacttgtcgtgacctctgaattaacaaatgccactcctgctgcgtatgcggctcacgatgtatcgagaaaaaacacagcatccatcgctgatgatttcttcgatgaaaaaatcggtaaacagcatacagtcgatgtcatgcttggcggaggtctcgtcgattttgtccgaaaggatcgtgatttaacgaaggaatttaagcaagctggatatgattatgtcaccaataaagaggccttacaaaaaaacaaaaatcaaaaggtgttaggcatttttgcagatggcggtcttgataaagcgattgatcgtgataaaaagaccccttccctgcaagacatgacgtcctcagccattaaacagctgtctaaaaacaaaaatgggtttttccttatggttgaaggcagccaaattgactgggcaggccatgatcatgatattgtgagtgccatgagtgaaatgaaggattttgaaaaagcatttgaagaagcgattcgttttgcaaaaaaggataaaaatacgttagtcatcaccactgccgatcattcaactggcggactctcctttggggcagacggctcggacagctgggattataaaccggtaaaagcagcgaaaaagacccctgattttatcgcaaacaaaatcgtcagtggcatgactgttgaatcagcgcttaaacaatatatcgatcttgatttcacaaaagaagaaatggcctccattcaaaaggctgctgaaacaaaggatgctgttaaaattgatgatgcgattgaagaagtgatcaacgtgagatctcatacaggctggaccacatcaggtcatacgggtgatgaagtgccattctttgcgtatggcccaacaagccaaaagctaaaaggtctgatggaaaacaccgatcaagcaaaacacattttcaaactgctgaaaaaccaataaaatcggcaaaaaaagatgtctgctcagagacatcttttttgtttttttaggcgagatattttctatgaactccttttccatcatacgaaaacatgacttcttttccttcaagaatggattcgatatgcacacttcttccccatagctgatgcaaatatgggagtactttttctaagtatttcaaatctagttcaatgccttcataccaatgtttaatatagagttcattgttttttaaatagtcgccatccatcacggtcaaataaggaaaaccgccattgaccctcatgctgactagctgatcacgaacagccttccattctttatcgatgactttataatctctcccttgtttttgaaacaagtacaaatcttctctcatcacaaggtcttttgttaagtaatttcgaatgaaggaaatatctgattcaatctccctgacttcaaacattttgctgcggcctgatccttctgtcacccctgccttttttaattcttcacatgggttgtcatagcgctcttcgatatcttcaaaaatcttcaaacctaaatagtaaggattgatgcccgtttttgacggctgcaccacgccagcatttaatttggcaaactcaatcgattcacttgaatccaaatcaagctctcgcataatccgctgatgccaatacgatgcccagccttcattcataatctttgtttctagctgcggccaaaaatagagcatttcctccctcagcatcgtgaggacgtcacgctgccacggctctagctcccgggagtgcgcctcaataaagagtaaaatatctttttccggctttggcggaaatggcttggcgattttctttttctcacgtattttcggctcatccattccccacaaatcatcatacggcgtctgacgctttggtttgtcatcttcatattcttcttcatcgccgatattccagcttagttttgaacgtacaagagacggatcaatatgctcctgaagagccaatacggcgtctaaaaaggattcaacttcttttgttccatgaaggtgctcatattccttgatccgctctgccgctgctgacatactttctaccatgtctcgttttgtgttttgaaaacggcaattatttttgaagaagtcacagtgagccagtacatgagccacaattaatttattttgaacaagcgtgttgttatcaagtagaaaggcatagcaaggatttgaattgatgaccagctcataaattttgcttaatcctaaatcataatgaagcttcattttatgaaattgtttcccgaagctccagtggctgaatcgtgttggcattccatatgcaccgaacgtataaataatttccgcgggacagatttcatacctcatcggataaaaatctagaccaaatccttctgcaatttctgtaatttcatcaatggctctttgtaaaagacgtttttctgatacgctcaaggaaaccatccctcctcatcggacttatccctactatatgagcgcatctaaaaaaacatgatgttccgccattcgtttagacgacttccatttcttttgtggactgcccaccgaatgactcgaaatgtatattctgttctggaattcccagctcttttagtatataaatcatctcttgtgtaaataccggggaaccgcaaagataaaattgccccttcccttctccaaccactgattgaaggaatggacggtcaatgcgggaagctgccttttcaacaagctcacctttaccagactgcgcaaattgttcattacataagaggatgcgaccatgcggagctgaagctagaatgctttcaaattcatgttcaaaagcggtgacatcctctaatcgatctgcatgaatcattgtaaatggctggctgttttgcgctgctgttttcaataaaccaatcattggtgtgacgccagaacccgcactaatgaaataaacaggctcttttgtgtcttcttgcaagcagaacattccctgcggcatactcacttgaagaacgtctccttcttccatttcatcatgcaaaaatgtagacacatgaccatcgcgcttcactgtgatgcggtaataagatggatgatgctgatctgataagctgtattgtctgctgcacatataagcctcacccggcatatctgcctgaaccgtaatgtattggccggcatcaaacattggcagctctgattcatcttctggtactaaataaaaggagatcagtgctggagattcctgtacttttttcttaatcacaaacggtttcacatctgaccatccgcctgtttgttttacattctcctccatcatttctgcttcaatcgtaataaagatattcgcaatgatgtcatatgccgccttccaagctaaaagtgtgtcatctttttcagttaaaccaaacacttctttcatcgcttcaattaggtgatatccgacgattggatattgctcttttttgaccatcacactgacatgcttatgggcaatctgtttgaccgcaggaagtaattcttctaatcgatcgatatgcagtgcagcttggtatagtgttgcagcaagcgcctctggctgacttccgttcataaggtttgttttattgaattgattgagtagctctggatgctggcgaatcatattttgataaaaaacagtcacaagttgggttccctcggcttttaataaaggggctgattgtttaatggcattcatttgatctttagataacatcgttattccttctttcaaaagatgtattttaaatacatctttatcgtaatggatgacagcttataaaagcaatatttataatacatgttttaaatgttgtcacatttaacactttctcgaacagtttttgtctaaagtgtgttacgatgatacaaaactctatcaggtttagaggtcgtcaaaatgaaactaacgaattatacagatttctcattaagagtactcatttatttagcatcaagagagaacaatgaactgtcaaatattcagcagatcgccgatgtttatggcatctctaaaaatcatctgacaaaggtgatttaccatcttggaaaacgcgggtatgtagaaacaatacgtgggcgaaatggcgggattaggcttgggaaaagcccagaaagcattaacattggagaggttgtccgttatacagaggatgatttagtcatggttgaatgctttgatccaagcaaaaacaactgtatcatctccccgatttgttcattaaagcatgtacttcatgaagcacttactgcttacttgcgcgtacttgaccaatacacattaaaagatttaactcaaaacaaagatgctcttagagagctcctcctttaggcgaaagaattctattctttcgtctttttctttacctccttgtaataataattaatttaaaattattataaataaatattgactatcatgtttgattcaatataattagggtatatagattgctagaaaccatttttttgtttacaggaggagaaaaagaatgacaaattcaaatcataaaaatttgacaacgaaccaaggcgtacctgttggcgataaccaaaactcaagaacagctggtcaccgcggacctacatttcttgatgattaccatttgattgaaaaacttgcacacttcgatcgtgaacgtattccagagcgtgtcgttcatgcaagaggcgccggcgcttatggtgtgtttgaagttgaaaatagcatggagaaacatacaaaagctgcctttttaagtgaagaaggaaaacagacagatgtttttgttcgcttctcaaccgttattcatcctaaaggttcacctgaaacattgcgtgatccgcgcggctttgctgtcaaattttacacagaagaaggcaactatgatttagttggtaacaacttgccgatcttctttatacgtgatgcattgaaattccctgatatggttcactctctcaagccagatcctgtaaccaatattcaagatcctgaccgttattgggattttatgaccttaacacctgaatccactcatatgctcacatggctcttctctgatgaaggaattcctgcgagctacgctgaaatgcgcggttctggtgtgcatacatttagatgggtcaacaaatatggagaaacaaaatatgtgaaatatcactggagaccttcagaaggtattcgcaatttatcaatggaagaagcagcagaaatccaagcaaatgatttccagcatgcgacaagagacttatatgaccgcattgaaaatggcaactacccggcatgggacttatatgtgcagttgatgccgctgagcgattatgatgatcttgattatgatccttgtgatccaacaaagacatggagcgaagaagattacccgcttcaaaaagtaggacgcatgacactgaaccgcaatcctgagaacttctttgctgaaacagagcaatctgctttcacaccaagtgcacttgttccaggaattgaagcatctgaagataaactgcttcaaggccgtctgttctcatatccagatacgcagcgtcatcgtcttggtgccaactatatgcgtattccggtgaactgtccttatgcacctgtacacaataatcagcaggatggctttatgacaacgactcgtccaagcggtcatattaactatgaaccaaatcgttacgatgatcagccaaaagaaaatcctcactacaaagaaagcgaacaagttcttcacggtgatcgaatggtgagacaaaaaattgaaaaaccaaacgacttcaaacaagctggggaaaaatatcgaagctactcagaagaagagaaacaagcattgatcaaaaacctaacagctgacctgaaagacgtaaatgacaaaacaaaattacttgcgatctgcaacttctatcgtgcagatgaagattatggacaacgattagccgattcacttggcgtagatatccgctcatacctgcaaggaagcatgaaataatggcttaagaatgttgacaaagggctaaaatgatcttgattttagcccctttgtcttcttttcagcggaatagaaaaccttggcagccctaggaaggacgagtattggcgcacatttatgatgtgagcaccagcacacaggacaatgcaatggtttgtctccacgctggagcacctctttaatagaggtgctttttttatagccggaatacgttaatactaatcaaatgaccggtgaccgggtgaaaatagatttctgcatgtgcagcaaaaagcgttgagccttccttcactgtgacgcgaaagacatcttttgtctgatcttcatttacttgtgtacgcccgatatattgataatcgtttaaagcggcgccttcatattcctcttgcagcgctgtatacgcaagtctttcccaattttcaacaggctgcatcgctgcatttgttgcaggatggatcatgaaactgccaaacaaaaccattcccgctgcaaacggcacccaccatttcggctgcatgatatcattgatctcactttcatgtatattttgtttatgttttgctgatcgatccattttcatacatgaagcatttattcagcctataattcccggtacacgattgatgcggacaccaacttttcccctgaaaatgtcgatatgttccgagcaaactaatgaggacttctcaagggaaaggagaaggtttaatgaatgtggcggattatgataaagcactttattatacgcatcgctcgcagtgggataatttacttattcttatggtacgtacgcaagatgacttgctctcgaaacgtattgagcatttcttacacgcgtatcaatttaaccggaacgatgctgatgttgaaaaatgtttatatgggctcctgcagtacattgaccatgcttcagaggctgctgcttctgaagtttattcacaaccgatgtacacataaagaaaaaggctgatgatcagcctttttacatacaattagcagtgcgcagtaattggaagcataaagtggtctttgacccaatcttgttttgtataaacaaacagcgcatcctcatcatttggcgccttcaccgtgtgtaagccgtcaattgacgtatcaggtgtaaaatagaacatcacttttttcgtcgtttcattcataatatgtgcaacaacttcctctatattttgtggctcaagagaaatgatatcaaagacatgtatggtttcattttcttcattcatcaggacaatcgtatccaatgcttcaatatagaaaatggcctccggccaaaccaatgtaaagtagaacattaataagctgccatgatcctcagcatctaatttcattgaacccgtttgacgtttttctgcgaactgttcaagtaatggcaggtcatgttccaatgttagctgcttgaagcgcatgtccttatttatctgaatgacgcttttgccgatatcgagactaaattcactttcgtggtaacgggtaaagccgaatttcggatagtccagtacagtttcattggcaaaaagaaaaatcaaaccacagtcatgttcgtacgtatccataatatgctgcattaactttgtcgctaatcccttgttgcggtaggcttgatccgtcatcaccgtgccaatttgaacagctcgatacgtttcgccatcaatgatcagtgacatgagataaacggaagcgtttgagatctctttcccgtgatggacaaaggaataaggaatatatttttcatcccaatatcctcttttgtaccagtcactaaaatccaaatcaaaagttttgatcgctaattgattaaagctttctttcaattcgttatcatagcgataatcactcactaattcaatatgtgtccatgctcatttcctccttttatcatttcacctctagtcagccggtttatcaccaccttcaaaataaaaaaagacttgatgagcagatactcatcaagtcttttaacgtttatctcatagaaattagactgaacacgcttctcttatcacgcaaaagggcacgtcaaataaccaactactgtgctctttttattcaattcattgaactgaatgtgtgcttaaaagttttagcataacgactaaattcccttctgttatagcagctctttgggctgacttttttgataatccactgcatatagagccgcttgggtacgatctgccagctctagttttgataatacatgagatacgtgcgttttgacagtcttttcagaaatgaacaaagatgaggcaatttctttattgcttttcccctttgcaatttcgaataagacatctcgctctctattggtcagctctttcattaactcccatctttgctcttttggctcagtcaaatgctgcacaagaaaattggtgatatgaccatctaattgataggtgcccttttgtacgtcaatcattgtcgtaagaagtttttctggcgctacatccttgagctgataggcttttgcccctgcttgaatggcgggaataacataatctttatccgcatagcttgtcaggatcacaatgcgggtatcaggcatttccagcgtcatttgtttcgttgcctcaatgccattcactacaggcatcgataaatccatgagaacgatgtcagggcgggtttgtctgacaatttctaatgcttcttctccattagaagcctcaccaacgatttcaacgtcaggctgtgtctgcaggaaaaacacaagcccttttctcacaatatgatgatcatctgcaatgacgactctcatgacgaccccttcctttcttgagaaaatggcacctttacttgaatagtggttcctttaccgagctcagactctatacaaaatgtccctccagctcttttgatgcggtcagacatccctttcagaccgagtgaaggaaggctcatttgctcgtcatactgaaacccttttccgtggtcgatgattttcatctcaaacgtgtcttttgattgttcaagctggaccttaacttcctctacttccgcatgtttttgacaattattcagcgcttcctggcatactcgaaacaacgtttcatgctgggtatgatccatctccatacagcctgataacgataatgtacagcgtaatcctaaaagttttgcatattcttgaatccctgttgtgaatcctttttcaagtcctcttggccttagctgccaaatgagtgaccgcatttcaaccagtgcatcttgtgacaaatgctgaataaaatcaatcatttcccctaaattctgatcgtttgtcatttgacgggcggctttcgcagtcagactaactgaaaatagcatttggttaacggaatcatgcaagtcctgtgcaagccggtttctttcttccaaaagagcatgctgatgttcgttttgcacaagcttcatccgttgaatagccgtaccaatttgaagcgcaatgctttcaagcaagttcaattcttcttgcgtaaatgtgacttttccttttgccgccacattcaataatccaaacgtacgcttacatgctttgagggggaccgtcgcatgatgcgtaattccttcagtatccccgagctgctttttcatcgccgtttcgatgcgtttacaattcataatgtttgtggctgattggagtgagccttttgtgtatcgattgatgcaatagcaatcgttttggcacatgagctctttttgatgctttgccagcgcttcgggtaaggagacctctgccatcagttcatacgagccgtctttttctataaaataaatccatgctgagtgaaagcctgtgatatccatcagcatatgaagcacttcatgaagcgtttctttcatttccgtgccttcatttagcttttcagcaatttcttttaacgtttttaatgtctcaaccttctcttggtattctcccatactgtttacccccggcatttgctgccttctcttttcattacgcctcattatatcatgagcattctgccggttctttctctaaaaggatgattttttctcatccttttgatggagaaaaagccatcatgcattcacacgatggccttgtttgtttatttagctgtttcttccacgatttcataaacgactttcatcacttcttctgacaaatgcttcagctttttttcgctatctgttaacgatgtacctttgacagccatataaaatttcactttaggctcagtgccagaaggtcttaaacagaaccacgagccatcctcaagaaaatacttcagcacgtttgatgctggcagatgaatggtttcttctttcttttcggaaacgaggtgtctttgacttgattggtaatcctcgatgacagtgatgcgctgacccgcaatagcagctggcggatttgttctaaaggtatgaaggatcgctgaaatttgctctgctccttcttttccttttaaggttaacgactttaacccttcccggtaaaatccaaactccttgaaaatatcaacaagcgcatcgtacaaggacttgccttgttttttatagaaagcagcaacttcgacagctaacagcgctgcttgcaccgcatctttatctcgggcaaagtcgccgattaaatagccatagctttcttcgtatccgaattgaaatgtgtattctccgctctcttcgaattgcctgattttttctccgataaacttaaagccggtcagtgtgtctatcgtatgggcaccaaatgcggaagcaacagcacgcccgagctcacttgtgacaatcgttttcatcacaacaggacgaggcggcagctgaccaagcttttgtttttcagacaataaataatggagcaatatggctcctgtttggttgcctgttaagacggtaaactctccatcatgatctctgactgcaatacctaacctatccgcatctgggtctgttgcaatgagtatatcggcattctgcttttcgccaagcttgatggcatactcaaatgctgcatgctcttctgggtttggtgatgtcactgttgaaaattgcggatctggtctttcctgttcaggcacaacggttacatgctgatagcctaaagcttgaagtccttttcggacaggctggttggccgtaccatgaagcggtgtgaaaacgactttaacatcgacctcacctgccagctcagggtggacactgatcgtttttaatttttcaatataagcatgatcgatttctgctccgatcatcttgatcagccctttttgttttaacgtttcttctgaatcaactgaaatcgacagttcattttctattgcatctacttcttgaatgacttgatctgcctgaaatggtggcagctgtccgccgtcttctccatatactttatagccattatattctggtggattgtgacttgctgttacgacaatcccagcaaatgcattcagctctcgaacagcaaaggagagctctggtgttggacgcagttcgtcaaatacgtatgtttggatgccctgtgaagcaagagttttggcagcttccatcgcaaattcaggcgatttatggcgtgaatcatatgcaatggcgacgcctcttctttttgcatcctctccatgtttcgcaatatacgcagcaaggcctgcagatgctttacgaaccgtgtacacattcattcggttcgtgccagcaccaatctccccgcgcattcctccagtgccgaactcaaggtttttgtagaaacactcttcaagtgcttgttgatcatcttgatgtgcctccagccattcccttagctcagtatccaggtgcttctcattgatccatcgctcataattcgtcttccaactcatggtcgtcctcccagctcttatcatcaataaaataacctctactgttattttatatggaatcaacctttatgtcatgctatatcgttgggagatgaagaaaatgatgaacaaataaaaaaagccgatacatgatcggcttcagattgttgacaaagggctaaaatatacttgattttagcccttagcggcttttcttttattcagcatcaagcggtacaactgcttcatggaatagttgatctaattctgtttgatgcttctgtttgactgcttcatcccagccaaaacgctctgccatataatcaacgacaggctgtgcatatttttttgcccagttgatattaaataatagacttcctgttcttcttaagaagaaatcgacaggggtaacagctaattcttcttcgattgcatagacaagctctgcgagtacatacgctggaatgtttcgtttgtctgcttcaccttgaagctgctctacacgtttgaaaagactgctgacatttgagccatatttttcggcaagtttttgagcaactggttctgttaaacccacagatgctccttctgctgttttcgcttggacaaaggcagccatattttttgatccgcctacatgaccgcctgaaattggcatatgctttgttttacatgatccaaagtctttgcctgtttcttcttttagtccatcacgtacaagattcacaatgtgctcagccattttgcggtagcctgttaatttaccgccagcaatggtgattaagcctgaagatgatgtccacacttcatccttacgagaaatttctgaagggtctttgccctcttcatgaataagtggacgaagaccagcccagttagattctacatctttttctgtaatattgagatcagggaacatgtattgaatcgctttgatgacataatcacgatctgcttttgtcatacgcggatgttccagctgctttttgtacactgtatctgttgtaccaacgtacgttttgccttctcttggaatcgcaaagaccatccgtttatcaggtgtgtcaaagtagatcgcttgttttaatgggaagactgattggtcgaatactaagtgaatcccttttgtatgctgtaagtgcttcccttcttttgagtgatccttgtctcttagctgatcgacccacggacctgtcgcattgacgattttcttcgcatatacatcgtaggttttctgcgtcatgacatcttcaatgacaacaccgaccactttgcctttatcataaataaattcttttactttcgcatagttgaccgcttctgctccgaatttcacagcctctttcatgacttcgattgtaaggcgtgcatcgtctgtacggtattcaacatagtagcctccgccttttaaaccgtcctttttcacaagcggttcttttgcaagtgtttccttcgcacttagcatgcttctgcgttcactatgcttgacgccagctaaaaagtcatacactctaagcccaatggatgttgaaaacttaccgaatgtgccgcctttatgcatcggaagaagcatccattctggtgttgtcacatgaggaccattttcatatacaatggcacgctctttaccgacctctgcgaccattttcacttcaaattgttttaaataacgaagtccaccgtgcactagtttcgttgagcggctagacgtacctgctgcgaaatcctgcatttctgcaagaccgacacgcattcctcgtgaagccgcgtcaagtgctgtacccgcgcctgttatacccccaccaatgataaacacatcatatggtttttttgtcatttcctgcagcatttgttctctttctaagctagaaaaagtcatctcttgttcctcccatgttgtacggtaaagaaaaagagaccgcaaacacccaaagcgtatttctacacttcggtgcctgcggtctctccagttctccaaccgttctattaacttacttgaagtataccatacttttggtttatttgaaagcttgagctgcttttacagcctttttccacccgctgtataacgagtcacggctgtcttcttccatcttaggatcaaagcgcttgtcaaggttccattgttttgcaatgtctgaacggtcgttccagaagccaactgctattcccgcaagataggccgcaccgagtgccgtcgtttcattaatttctggacgctctacaggcacatccagtaaatcactttggaagcccattaagaaatcattctttacagctccgccatcaacacgcaatgtttttaatgaaatgtttgaatccttttccatcgcatctaacacatctttcgtttgataagcaagtgattctaacgttgcacggacaaagtgctctttagaagtaccgcgtgttaacccaaacacagcgcctctgacatcactatcccagtatggtgtgcctagaccaacgaatgccggaacgacgtatacgccatctgttgactcaacgcgctctgcataagcttcgctgtctttcgagtctttaaacattctgagtccatcacgcagccattgaatcgctgagccagcaacgaaaatacttccttctaaagcatattcaactttgccgtcaatgccccatgcaatcgtcgttaataaaccatgatccgacttaatggctttttcccctgtattcatcaacatgaaacatcctgtaccatatgtgttcttcgccattccttcttcaaagcaagcctgaccgaataaagcagcctgctgatctcccgccgctcctgcaatcggaatatttctgccaaagaagtgatagtctgttgtttcaccataaatgtgtgaggatggtttcacctctggaagcatagaagccggtacgccaaggatatcaagtaattcttcatcccatttcagatcgtaaatgttgaacattaatgttctggacgcattggagtaatctgtgacgtgtgatttaccgcctgtcatcttccaaatcagccaagtatcaattgtgccaaacagtaagtcgccattttctgctttctcacgggcaccttctacattgtctaagatccattttacctttgtacctgagaaataagcatcaatgagaagacctgttttatttctaaacgtttcattgtgtccttgttcttttaactcttcacaaatgccagacgtttgtcttgactgccaaacaatggcattgtaaataggtgcgcctgtatgtttatcccaaacaaccgctgtctcacgctggttcgtaattccgataccagcgatttggtctgcttcaattcctgattcaattaaagcagttgaaatgactgatagaacagagctccaaatttcatttgcattgtgttctacccagcctgggttcggaaagtattgattaaattccttctgagctgtatgtgcaattttgccttcttgatcaaataagatcgctcttgtgcttgttgtcccttgatctaatgcaagaatatatttttcttttgtcatgatgttttcctccccttacatactttcatttacagcatttgtttggtttttcgtagagacatagagtcctaacaataccacaactaaaataacgcttacaatccaaaaggctggagtgacgttcgctttaaaggctgcattgtagaaaacaccgccaaatgcaccgcctaaaattggaccaacgactggcacccaagcatacttccagttcgatgggccttttcctggaatcggcaagatcgcatgtgcgattctcggacctaaatcacgtgcagggttaattgcataaccagttgttccacctaaagaaagaccaattgcaacaattaagaaaccaacaatcagcggattgactccgtctgcaaatttatttgcaccaatcgctaagattcctagaaccaatacaaatgtaccgataacttcactaagtacgtttgcaaaagtatgcggaatcgcaggaccagttgaaaatacacctagttttgcacctggatcatctgttgctttccagtgcggtaagtaatgtaaaaagacaatagtagcccctattaatgcgccaagcatttgaccaacaatatacattggaacatcagcccaaggaaaacttccttctagcgcaagcccaattgtgagtgcagggtttaaatgagctccactaattccaccagttgcatatgctgcaatggctactgcgaatccccatccgaaagcgattacaatccagccggattgatatgcgagtgatttctttaaattaactgccgcacacacaccgcctccaaaaataatgagcagcattgtacctacgacttctccccaaaatggtgtcatgaaaaattcctcctctggttcagttgccatcccctatgaatgtgtagaaaagataaagaaaaagatccacaacaaacatactttacattagggtcatttgtcacctagtaaagcgttgttgtggatctccatttctccatcacatgatattaacttagtgctatagtatcagaggatgaaaacgttgtcaataaatattcacattttatctttttacttttggaacgctttccaaagggtggtatttgaggtcgtcacagctgtagcccctgcttcaagcgctctttctacatcttcttttgtacggataaatccgcctgcaaaaatcgggatcccagttcgctcgcgcacttctgtaattaaatctggcacgacgcccggcaatacttcaataaaatctggacgatgtttcccaacgaactctatgcttttttccatggcactcgtatcaagtaaaaacattcgctgaatggcatatacctttttttgcttggcttttactatgacagaagacctagtagaaataattcctgctggcttcatttcctgacaaataaattccgttccatactcatcatgtttaatcccgtgaatgagatcgacatggacaaacatttttttgtgatgagcatttgcctcattcatgatgcccttaagccggcctaagtgaacatcaagtaaaacaccatatgtaaatggactttttaaaaattcctcaaattgcttcatattgcgtacagcaggtaaaatgggttgatcatgaaaactcatagccgtctccttcaaaagtgtattggatcagtcttctcctaacagtaatagaaactcttctatttttcaatacacgtagtgtgcccaataccgctttcatctcacatcaccttcctagaactagctcaaaatgatgaaaagcaaacttttattccataaaaaaaagcagagaagtctctctgctatagctgtgccatgctttcttttaaggtattgatgataaatgaggcgtcatcatctgttatattaagcggcggtgcaagctgggcaacgttattatagccggccactgtatccccatttttcccgatgatcagcccgcgttttttacattcagcaatcaattggccgacgacatgtggttcagctggttttttggattgttgatcctgaacaagctcaatgccaaatagcaacccttttcctctgacatctccgacaaatgggtgttcttttaactcttgcaaacgttcaagcatatcccggccgagcgcatcggaccgttccactaattgctcgttttccataatctctaggttcgcaagtgccaccgcacaggaagcagggtgaccgccaaatgtattcacatggcgcagcctgtcatacgtatcttctcctgcataggcttcatagatttctcgtttcacgcacgttgcagaaagtggtaaataaccgcttgtgatcccttttgccatggtgataatatccggctttacttcctcatgcataaaaccaaaccgcttccctgtccggccaaatccgcagatgacttcatctacaatgagaagcgctccatgggcttcacagatatctttgaccttcttcaaatacccttttggcggcattaggatacctccgcccgtaatgatcggctccataatgaccccagctatcgtctcacttagttcccacgtcatggcctgatctattgccgcagcacttgccagattctcttgatcctcaggatgacgatacatatcaggcggtgcgacatgaataaagccctgacctaatggttcatatttatatttacgctgcgcttgaccggttgcggcaagagctgctgctgtattgccgtgatacgaccgataccgggagataaactttgtcctagtactctctcctttttgcgcatggtattgtttagccattttaaatgcagcttcgttggcttcagaaccgctgttagaaaagaagatgacataatctccgccaagccactcatttagcttttcagccagctgaatcgccggcacgtggctttgtgtaagcggatagtaaggcattgtctttaattgcttatacgccgcttctgcaagctctctccggccatatccggcatttacacaccaaaggcctgacattccgtctaaatagcgattcccatgaatatctgtcacccaagcaccttcagcctcgtgaatgaccatactttcattttccttgtttgtccctttcatatgatgccaaatcaactgatcatctttcgcctgaagattttgagcctgctcatgtattttcatcttcccgcccccatgtatccgttttcatcattaaagaagcttagaccagttcagcagcacattgccgctccattcattatatggatgaaacgtgaggcttatgaaactggcactagaacgcctgtaaaagagaaccaatcgttactttcattataagaaaggggtcaggccgattacattagacagatcgtcaactgattgaacaccatcataagacacttttcttaatgccttggcaaaatcgctaacgtttatttccttgcaggaattcatgagcaagaatcgcaaattcaagcgcctgtcgtttcggcgccttcatcatatcctcaccgagcaaggcatgcagtttatccagtctatgataaagagtttgcctgacaatataaagctggcttgcggtttcttttttagaaccgtttgtttgtaaaaagatattcagcgtttgatagagtctcccgctattttgattatcgtatacaatcacgggctctaaatactctttcaccatacattcaagcagaccgctttccttcatcataggcatgagacggagcatatgtagatcttggtaaaatgggctttccacccgctgaggcatcactttttttaaatgcagcaattctttggctgcttgaaagctttttctcatgtgctgaaatttttcacaatattgaccgataccaaaatagatctcggcccctcggggctgctcccgattatacaattgtttgatgtcgtttgcagccttttccgcacgctctttccagtcctctttctttctcgtgtttagtaaaataaacaaggtttgttcttgatgctcatatgcaatcagatggaaaccagcacgctgaaaaatggagcggcaagagacaagaaagtaaagattccctgcgatttcttcaatttgatgatgcttttgaaagagcaagacgacgcagccagttggctttttcaccccttctgtttcttcaaggtgctctataatctcttgttctgtatgctcttcttgaaaccatttttgcagccattcattttcttttgtctttttcagttcttctgtataaagctctcttaatgtttgctgggctagagcattcgctcctttatccatcacaagcagttcaaattcagagagcgtgtctgcttgatgaatgagcacaagatctgcaaatgtttgtttgagtgcaagcacttgtttttgtgtcacttcgtatccttttggcacggaagcaaactgcaaataattcatgaccagttcttccgtttgtttggaagaatcgcataaaataatcggctcgccctgaacagggaggagtaaaagaatcccccttacatgctgatacacttgatccaaaatatccatctgcggatgcggagtcagcaaaagctcatttagctttgatgacagtgcttctaaatcagccatcatttgatactgacgctcgatcatcatcgtatgaagatgctgcgtgatgttgacgaacttcacttcttttgtaaacagaataagcggaaaatctctctcttctgcataagtcagtaattcttccggcacttcgaatcttagcgggacaaattcaatacacaagccggccgcccctgaatcaatcaactgtcgtaaaaacgcttgaaacacatccggttgatcatggaagcctgcggctgttgttaatataagctcgccgccatttaataaatcctctacatcaggaacttctaacacatgtatccatttgacctgccgaaacaatcctttttcccctgctaacacttttgcatgcgcaaaatgcttcgttttcaacacgtcactcacttggaaatgaacatctacattcattcatatgtccccctttgtttgccgcctatcccctatcccagagggtgcatggataaaatccataataaaactggtaatgtcacgatacttaagattgtactgagaaatgtcgtgcttgagacaaactcaggcttcgttcgaaattgtacagccatcagcgtggtatttgctgctgtcggcatcgctgccactaaaatcataatttgtttcaccatatcatctactggtaaaataagcgtaaagccaaatgcgatgagtggggagataaacagcttcagcaatacagcataagaaatattgcgaaaatccacttgcttaaaagagatcacggcaagctgcatgcctaaaataagcataatcgtcggtatggccgcattccccacaagctgaatacccgtcatcagctctttaggtaatgaaaggtcaatcagctgaaataatagaccgatgagcgccccgtaagcaactggcatacgcagcacttttttcaagacgacctttccatctcctgcatcctctccgccctttgctgcataatacatgccgattgtactcatgacaagctgctgcagcaccatcaacacgatcgcaatatccaagcctgcggctccgaagacaagcagcacaacaggcgtgccatagtttccattgttcataaaggctgacgacagaatcatggcgcaatacgtttcattcgaatacccataaatacgagataaaataaagacacataaaataagtgcaagacaaagcccgacaacaaaaatggataaatacacatagtccatcgacactttgttttgataaaaggtttcaaacgcaagaaatggtgacattaaatataaagacattgatgagagcgtatgtatgtcaaaaccaatcgccttctgcccgatatacccgatcaggaatatgccgaacactggcagtaagacaagtaaaaactccatgctgcacctacttttctctagttgaattccagattccttctgctcctcattatcataccactgataaacaataaaaaagaagcacccttatgaaaggccgcttctttcctcatccatataaaacacttcccacaaatgaccatctagatcctgaaagctccatccgtacatgaactcatgatcctgcttctccttaaacggtgaaccgcctgccgccattgcctgctcgacaagctcatcgacctcttcccgtgaatgaacgcgcatagagattatcacctctgatgctttttttgcatccactaattgtttctctgaaatagattgaaaatgtctaagagataacagcatgacagtgatcgtgtcatcaatgaccaaacaggccgcctgatcattcgtgaactgctgctcaaattcaaaacccagccgctcaaagaaagcgatagattccttcacatgatttaccggcaaattgatatacaaatgtttagattgtcgccccatgttcctctccttcttgaacacataatctcctttaagtatattcagctttttctccagaatccctttgtcaattgaaaaaatctgatgtcatcaaaaagaagcgcctcaacgataggcgcttccttcattatttcttatattcaatatggtacacatctcttcttcggtctttcagttgacgtacagtcccatcttgtctttgtcttcttaaaatttctaaatcgacatcacctacgacgaccatctcaatgtttggattacactctcctacaatcccatctcttgcaaattcaaagtctgatggggcaaatatagccgattgtgcatattgaacatccatattttcggtttgcggaaggttgccaactgttccagagataacggtataaatctggttttcaactgctctcgcctgtgcacagtaacgtactcttaaatagccttggcggtcttctgtacagaacggagtgaaaataattttcgctcctttgtccgctgcgatccgtgcaagctcaggaaattctatatcgtagcaaatttggatcgcaattttgccgcaatccgtatcaaatacccggacttggtcacctgctgaaatcccccaccattttctttcatttggcgtgatgtgaagtttatattgtttttcaatcgttccatcacgtctaaataaataggcaatattgtagattttcccttcctcttctacaaagtgggaaccgccgatgatattaatgttatatttcacagaaaggtctgtgaacaaattgatgtagtcctctgtatattccgtgatccgctgcacggcaagacttggtgaccgctcttctaaataagacatgagctgcgtcgtgaaaatttctgggaatacggcaaagtcagctgatgcatctgatgcgacatccacataatactcgacctggttcataaattcttcaaaggaatgaatttgtttcattgcatattgaattacacaaattcgaacagggaacgccgatttataatatcttttcgattgcgggcgataatcgacattgttccattccattaacgtcgcatatgtgctggatgctttatcatctggcaagtaattcggattgatccgcatgagactaaattcatttaacagctgaaaagataaaacaggatcataaatttggtgaagcatgacctgctcgacatactggcgaggcgtcatttcgtcttggtatttatgatagttcggaatgcgcccgccaatgatgatgctttttaaatttaatcttcttgctaagtcttttcttgcttcatacaaacgatgtccaattttcattcgtcggtattcaggactcaccatgacttcgattccgtacatattcattccatcaggattatggtttgtgatgtacccatcatctgtaatgtcctgccacgtgtggcgatcatcgtattcatcaaagttaattaataaacttgaacaagagccaataatttccccctcaaattcagcacaaaactgcccttctgggaaatgctcaagatggctttcaagatgctctcgtttccaaggatccatgccaggaaagcatacctcttgcaaggcaatgattcgatcaatatcctcttcccggatattacggatcaccattcttttttcaaatcgcgttaagtctagtttttctgccatgatgtatttgcccccttactgatcctctttttcaagctgatggaatagctggagcaattcgatttcagccatggattctaatctgacatcatattcttcaaattgcagcgtgctcgtcactttgtttgggacgatgacacatttcatgcctgcgcgtttggcagctactgatccatttacagaatcctcaaatgccacgcaatcttttggctctacccctaagcagcgtgcggtttgcaaatagagctctggatttggtttcacttcttccacatcatctgatgtgcggatacattcaaagtagtcgaaaagaccaatctgcttcaggtgatcagacacccatttatagtctgagctggaagcaagtccaatcttaatccccagctcctttgctgcttctaaataagcttctacgccaggtcttgctgattcgtccttcattctttgttgaaaacgagaacgccgatctgctgtgagtgtctcatgatccagcgtcttccctagctgcttttccaaatattcaaatggcttaaagcctgcctgcgtgccaatgaccttgccccatacagaaagaggcagatctgacttgtgctccgcaaacatttcttgtaaaacctcatattcatgtgtttctgtatctaaaattaatccgtcaaaatcaaatataatcgcctttaccaacgaggccactcctttttttacaaaagtcttaaacatatactccatgctatcatatcgtgaataaaattgactttcaaagatgaatgtctgctaaaatgattatgtataaaaggagcctgcaccattttgtcaggctcctacccgtgttcgatttattctgcaagagatccaagcgctccgattcgtggagaaataggcaatattgaaaaagagcgggtttggtattacagatcttaaaggtttctccgttcccttaaaaatagtatgtgcgagggccttgtaagttaacaaggaagttcacaccatcttttacgcattttgaaggtgacggctgacaaaatcgtctagatcaaaaggaaaagaaaagccgcaggcattgacctgctcacggtttcgctcgaataactcacgatcacgtttggtgatatgacgtttcggttttacaataatggtatgtaatagctgaagtcccgataaaatacgaaaagcatcatccatcgtcccgttatatacgccatcaataaaggtaagggaacgatctttttgacgcatatcccgctgctgtccattgacagcatgagaaagaagatcttcaacatcctttgatatttcttcaattgcctgctcttgcaggtctgtagcagctttcattaatctcatgtgacatctacctctctgtcgttatttctccattcagaatagcacagaaaaaaaggcgttcgccaaggtaagtgtttcctatatatacccatagagaggaacggatatcatgatcataaaaggacacacgctctcactcaaagtagacgagcagtatcatcacacatcactcagtcattttttaaagacggccgtatctgcatcaaaaccaattgttcatttttggatggagcatcaaaaagtccgtttaaatcaaaagcctgcccatcacgcggttaaagtcagtcaaggcgaccagatcatcattgatttatttgaaacagaagaaagtgatgtgacaccggaatacggtgaattagaggtactcttcgaagacgagcatttattaattgtgcaaaaacctgccggacgacccactcatccgaatgaacaaggacaaacaggcacactggcaaatcttgtggcgttccattttcaagcaaatggagaagaaaagcgggtaagacatatccacagacttgatcaagatacgagcggcaccgtcatatttgcaaagcatagattagcccatgcggctcttgatcaaatgctttctaaaaaaacaatcaaacgtacatacatcgccatcgcagagggacttttcaaaaagaagaaaggcaccatcgatgcagcgatcggccgtgacaaacaccatgcagtcaaacgaagaatctcccctacagggcaaaaagctgtgactcattttcaggtcatggacataaataaacgtttgcaactaacagcggttaaacttcaactagagacgggtagaacgcatcaaattcgtgttcacctgagcagtatcgggcatccactatctggggatacattatatgacggagttcgtgaatacatcaccaggtgtgctcttcacgccaagcaagtagacatgaaacatccttttacaggtgagcatctgatcatagaagcacctctaccacctgatatggaccagctcatgagtcaaatcatccattaacaaaagagcctgctttcatacgcaggctctttttctttattcagacactctttttgcataaataatataccgctctggcgcattgccaacgaaatgaaaaggatagcatgtggttaatatcagctcttccttttcattctgcaatgtaatgatggatgtatcatgctgatcgacaatttttgtatgtgtgatttcatatataaattcaccatacggcacagtgattttcagttgatctctaatatccaactcgcctgtccggcgaaacaccgtgtcacgatggccagaaaggacgatttgtccattttgatccggataataactgtctttgtagtgtcctactccctttgcaaggtcatccgcatccgtcccttcgacaatgggaaggtctgcttttaattttggaatcgtcaggatgccagaggctttccccatttcaggagcaaactgcttcttggacatcccctgatcgtccgccacgaccttcttcgcttcgtctaatgattgggctgtttgaagatgagtcgatgcgatttgccaaattccccagccgagaagtacaatcccagctgtcatcacagtcagtgcaagccactttttcatgcttaaactcctttgcttgttccatttctcttagatgatacgctctttagcttgctgctttttcttcttgttttgctttttgaattcgtccctctttttgatacacaatggaagctccctcaaagcttttcacaaaatcgacagtcgcttctaagtcttctgggcctgtttcagggttttgccccagcctgcctatcggtgcatatttactgccagttgcagttgccatgaagttattcacagtgagtgtatacgtttgatcaagagctacagctgaaccgtctggcagcttcaagtcgactactttatatgttaccggatcataggaatatgaaaagcctgaaatgctataatctggtccaaattgtggagaaatttgtgcttctatgatctctactaagtcttttcccttgatctctagtttgactaaaacgttgccaaatggctgaatattaaagagatctccccacgttatcggccctttttcaaggttttgcctaatgccgcctccattcatcatggcaaagtcacttttcattgaatatctcataccatccgcaatcaaattaccaagcggcgtgtctccatcatttgaatagccgccttccattttgaccccggcttctccaacaacctcactaattatcggctccacttctttcccgtaatgtgccaagatgtctgctgcttccttgtccttttctatacctgcttgatctatatactggattttcgcactctttttgacgatatccttcgttttacggtcaagtgtcacattgacttcgccaatcgcctttccatattcaaaggcttgcacaattaattttccattgacctctccattgaccacttcgtgattatgccctgcaaagatgacgtcaatttcatcatcaccttctttggcaagctttgcactctctccagtgattgtatctccattttgagaggctgtcatatgagctaaaaccgctatggctttaattcctttttgttttaattccttcgtggcttcattcacggctttgacttcatctgtaaactgaatgtctttaatcccttctggcatgaccattcctgcggctgacttggtcacaacgccgataaatgcgactgggattccatcgacatcgatgatttcataagctggtaaaagcggtttgccagtatccttgtattcacagttcgcacaaacgagcggaaagttctgtccgtcatacccctttgtgcctttaggatgatctccgccatttaagatacgcaatagctcgtctaccccttcatcgaattcatggttgccgaccgtgcccacatcaaatccaatgttctccatgagttcaacggttggttcatcttgtagaagagaagatattggagagctcccgccaatcatatctccggcatggaccgtaatcgtatttttgtgcgctgcttgtttttgcttcatataggccgcgacataatccattcgtccatacatgcctttattgccatcaccttttagatccagctcgtattcttgatcaattttaccgtgtaaatcattcatacttaaaatcgttaatggtacgtcgtccgcatcctttacaggctgataaccagcctgttctgcttcttctttggaagcaaaaaagatccgtttgtccacatcgatttctttccatttgtcaggagacacgtaggttttgacagatgagtcaccaacatagcgtgtcagtccttttttctgttcacgtgctctaaattcaaacggctgttccagcagagggtccgcttcgttccatatgcccagtcctttttcctttgcttcctttactgctttttgatacgtatgatagtccttttcatctcctactggccagatgaaataagtaggagcatatccttttttcacaagctctagatttgtatttaacccttttttggttttcacttgagctaaaagacgtccatagttatcctttgcttcaggaccaatctttaatgtgacctggtcaccgctcaaaagcagtgtttttaaatagtcagttgcttgctgtccaaaacgcaattggtttttgtctaattcgctttttggctgatgatacgtttcaggcgtgtccatattcacaaagcgcacctttgttgtacctaaaacggccttctttagatgaatcgtatctccatccaccacacggtcaaccgttgctttgtattctttcttcatctttggcggctttggctggcgtttcagcaggttgatatcatccttatgtcttggaagcacctgcagcgtatcatacctgcttaacacccctgtaaactcgtaccatttccctgtctttactttatcaatcgcattcgtatcgaccatcactctcagagtggtgctgtgatattttttatcaatgatcaccacattgtatccaccgccagccggctgcgctggttttgcctctacatagcctttgagctttacaagtcttccttcatgtttaccggcttgttccgtttctagctgcttcacagatactcgcttcgcctttggcaaggtttggttcacagcatctatcttcagactgccttgatctggcacaatttcaatcagtcctttataagacgtgattttaccagtcactgtcaccttcatccctgcttttagttccgagaagtgattgggctgcgctgaataaacattgattccagctgatttgtcttgaatgtatgtggacagtttcccattgccaacagctgattgatctgctgtcacaattccgctcaccgtcacagtctctcctatgagctgacgggcttttttgatctgcacaatctttttttgtttccacaccatttctttcttttcagatgcattgacctcgctccctgcggacatgccaggcaataaggattgcaaactaaagatcaccaaaaccaaacaacaaatcattcgaatagatagcattcgtctcattagacctctcccctttgcgcttcatctctcatagtgtacaaagtaaatattgatgttgaatggatttcatgtaaaacttgtcttttttaactcatcggaaaggtaataatcactcgtgtcccctcaaagcttttgctttcaaaacgaatggtgccgccatggctttcgatgattttaatggtcatcattaaaccaaggcctgtccccttttcttttgttgtataaaatggttcaccgagtttccctatttcgtcctctggtattccctttccttggtcttcaaagatcagcatcatttgctgatctttcatgagagaggccaccttgatgacgcctgtcacaccatccatcgcttctattccatttttaaggatgtttaggaagacttgttttagttcattcggaatgccttgaatgttagggagcgacggagacagctttttctgaatggacacgccttttaagaccgcctgagattcaacgaccatgatcacttcttcgagcagaagattgacatgtactggttcaaatttcaccgatttgcttctagaaagaacgaggaattcattaataatcgactcgagccgattaaactctgacatcatcacatctgcataatctttctgatacttcttactttgaatcatcagctgtaaaaatccttttaatgaggtcagcgggttccgtatctcatgagcgatgcctgctgcaagctgccctactgctgacagcatctctgatttcatcagcatcttctctgactgcttttgattggtgatatcctctgaaatccgcatgacggttgactgcattttgtcagggtcatcaattcgatgtaaagagactctctcccatcgttcacgtccagataaatcttgaaagtacagctcacctgtccaactgccctctcttaaacaaaccttccattgcttctctaaatcatcacattgacatagtgaatgatagacagaaaaaatatctttgccgatcaggtcatattcatgttgctggacaaactgacagaaacgctggttcacgcattggatgactccttcctcagttgccacaacaatatgaatatggctgttatcaagtgccgttaccgctagatgaagcgactgcttgattttcgttacttcagtcattttaatccaagtcatcaccgcgccttcatgttcttcatcgtagatgggtgtgatgtgaacagtgaattgctcgccttcgttcgtttcaatttcacgttcgatcgcgcgcctattcgatatgacggattggatatcatgatagagcgtttcctgcgtaagctttttagccatcgactgaaaggattgctgatgtctgattttcgcagaagtaaataaagaggcagctgtaggagtgtaatagtgtatattcatgtccctgtccacaaacagcgttgccagctccggcttgacagagggtctgtacagttcttctctcgtcacccttaaattgtttatgatatttatataatgctcgtgttttttctcaaactcctctaattgcgtgtgttttgcttttaattgagcccttgcctcctgctccttttgtttgacttcattgagttcattttccaaatcgacaatacgctgttgatagactgaattctgatctgacatccctatgtccctgccgttcttttgatttttccctctctcattcattcgaatgagaatgacgtaaactcccttaaaacggcggtcaaaacttttcacggtaaaatctgcatactgctttctgcctttttccgaaatgagaacatgttgaaacacaacctctgtctcgtctgtccacaccttttgaaaggtttgactgagcatctctttcatataatcaggtgtcacatattcacatgattgatctgacacttctgtatgatctaaaaaagaatacgcaccctttgatactgccaggattttgtcactatcgttgatgaccatacatgcatcataatccttgcttacttcttgcatatattgttcggctcgcgctttcaactcgatatcacgagcgtctggtgtccaagggacatgtggttttgaaacgtttgaatgagtgtaaatgttccatttttcattgaacaaatgaaacaaacgagggatattgggtacagtttcatttggccctaatatcaacatcccttggtcttttaaagcatattggaatcgggacaatactcgtttttgcacttcaggctggaagtacatcagaacatttcggcaactgataaaatcgaggtggataaaaggtgaatcgatcaataaattgtgaggtgcaaagacaatatgttttctaagcgactgcttcacaataaaagcgtcacctttcctttcgaaatatcgcgcccgccatttttccggcatccttgccatagactctactgagtaaagacctttactagctgtttgaatggctttccggttgatatctgttgcaaatacttgaagttcaatggtcacttgtcttcgcttcatttcttctaaaaataagatcgtaaaagaataggcttcctctcctgtcgaacatccagcaatccaaatacggcatcgagatttcccgtttttcaccgcattttcaatgatcgacggaatgatctgatgttcacatacatgaaaagcctccatatctctaaaaaaagatgtcataccgcttagaagctgtacgtgcagaaggtcaagctcatctggttctctttctaataagttgtcgtattctgataataatgaaatccgtttttttgcaaccttcattcgtttttgaatgacagatagcagccttttcctttcataggttgaaaaggcaatgcctttatacatttcaagtcgttcaataattctcagtaaaacaggatctgcctcatcgatgtgcggaacattcatgatattggagatatatgccgcaagggtggtaggatccttgaatgtttgttgatacaaggtgtcaaaaccactttcttcctcactgcacgataaagctgtaccgccctgctcaaccaactgaagcaagccacttcccacgcaatgacctttttgaaagaaaatcgcataagcctcctccttttgaacgctggcaagagactgaaaaagcaagtccacagagcaagccatgcacgccggcagctggtctgataggtgcagcctctgatcttctgttaacgtcaccaccgcatgctgtggacaaaaataaatcgtcttcttcatgactttctcaccatgtttaatcgtttttgcccggtagccaatcggtaaaacaagtgcttccaaatcagttatacaatcgcctgtcacatgattttgcacaacaataaaagaggcatttaattcatgtggaaatgattgaaaaaaagcctcaagatgatgctgttcaaacggcgaaacaccgatgccaatcactggtgtctgcacatgttcgtcttctatcaaacgattaatgattttgtcctgcatctggtacccccatgttcattcgtctgatactttttttcgacaaaaaggaagaaaaccctctaattgtaaataatgtttttgcatgaaagaaggaaaacatcctcacattaaaacagaatgtataaacaataggaggaatctctatgcaaaacgatcagcagacaaacgttcaaggaaatgtccagcagccccaattcaatcatggcgggcatgagttatttgatttacatgaagtattagcagggaccattaatattttggatcaatacatgatctttcgccaattcatccaagatcccgcattatccgacattttagatcgacaatatcaatttgtattgtcacagtataatgtcacagtagattgtttttctactggtcaaaagcctagtgaagaaacatctacgtatatgatgaaagaacaaacacaggtgacatacggaataaagccatctcagcctaagaagccaaatcaatcgttacaggatgtaaaagacacgggaattacagggcatatgctaggtctcgtgaaatcacatgctggattactttcaatgactgcactagaggtaacaaaccctgtggtgcgacgtgtgcttgcagcgcaaattccgaactttattgaaatggcgtatgaaattttcttatatcaaaataaacatagctattatcaagttccgcagcttacagctcaagatatgcaggcgatgacgtctacatttgccccaatgaagggccaagttcaaatgccgccaaacaaagccaatcagcaaaaaccgctccattaaataaaaaacggccgacctatatcctcaggtcagccgttttttatttgatatatcttgttaaactgatcttcaaaatctgcgagccgctgtcctgtcgcttgttcaaaacctctatcaaaacggccagttttcgccgtttcctccataatctcatgtatgacgtctcgtccataaagctgcacgagctcataaatcatatagtagctttgcacataaacatctgtctcatacgtcatccgggagtcctgccaatcttgatcggaatgaagagattgaaagggaatgacgtcgaaccgttcagacgtagcatttaacacatcataggccgtccattctgcagttccctcatggaaccaaaggggaaagatcaccggagacacttcgtaagaatgaactttttcatagaaaacaaagtgagcatattcatgaatcaataacgtgttgaaaaagtataaagggagtgtctctttcttcaataatgcttcccgtttgtctggatataaccctatcatttgatcatgatcagagtaaaaacctgtaatatgcttgatcccggcaaattgctcgattgtctctttatcatcaaaataaataatgtctaaaggtttgtcagtttcaaattgaaacactgacgctgtcctcttctttgcctgatccatggcctcgattgtcaaatcaacaaaagcgtcctcttcctctgcatagtatattctaatatgttcatagacttgcttattgagtccctccgttagaattgttttaggagaagactgctgctctaaatattgtcctgtcagctgaaacgcaacataaatcaagtacgcggtgaaagcataaaaaatgagacctgctgctatcattccgcctactagctttttatgaatcaaagacgacttggctttcatttgctccccacctgaattcatcctgcagcctctttctctttctatgaagaaacaaagatcaacaagaggtgatatattttttactttatgcagtcaggtgcgcaaggtgcggttccaaacaaaaaagccgcatatgacatacggcttttgtcgtagctattttgattcagggaagacacgtctgaccgtatcagtaaattcatcgaaaaatcctgagataggctctccgcttctaatacgttttccgtacccttccatgcggtcgacaaagtctggattggcagatacatacacattgtcgatttgttgatccgttgatttgactttatcagaaattttctttttcaaatcttctgccacattaccgcttttatcgccttcaagcataacggcaacaaatgcattctttcctgtaacaagtacgttcgctgtttttacttcagacatgttggctacaagctctgacgctttatctgccactttgaccttctgaggtgtttggacattttgctgatcctgcctcatgttgtcattcttatatgtgacattttcatactgtcgtttcattgttcctcttcgctcgtctccttggttgttcataccacatccagtggtgatcaatgctggaacgagtagtaaagatagcatccatttcttattcatcaattattccctccttttgctcttaggtttttcattcagccggctttttatgcatccatcctctctttcagcgaaatgaattcataattcagctttgtttggtcatcctaaacatgatgaagaagtatcatcacgatcaaatggagggattcgtttgtttaaaaaaagaaaaggcatgagcactggcgcaatgatcgcagcatcaacagccatcattgcattattttccccggttttaagaagaagactgaaaagcatgacgcaaatgaatatgtcttcaatgatgaagggaaaagatcaacagcaccatgactcgactcgacacgagtcacacacacagaaagaatcaaagggcactgcggaaatcggacaaatgatgaagcaagcattcactgctgtacagccaaaccattcgaatcagcacaaatcaacatcaagaaaccatcagccaagagagtcttatgcacagtctctccatattgatgaaagtgtcatgaatgtgatggatgatgaatcaatccagcaagtgatcaatgacatcgagcacaaataagaaaacaggagccttcatgtatagaggctcctgtttattctcctgaaaaatgttctttcaccatcacagagaagaaaggtaaaaaggtgatttcaactgttgccataaaatcgtgataagcttccattatgattaaaagctctttttcgttcggccggtcctttttgatctctacatgctgcacagttttaaaatcatagatgcctaaaacagatccatctttttttcgaacagcttttaacgtaaattcttgtcttccaaggtacatcgtgacaacgaagcgctcgtcttgattctcaaatcgaaatgtcaggctttgatattcaataggcatccctttctcgaacctttcatcaggctccgtttcaaaaaaagaaagccagtccgtttcatctgggaaacgttttcctcgcatgtgtttcgttcccctcataagtgaaatttttattaattatcctttttccccttttcttttgcaacaaattttagtaattttaaaaaggtgatttaattttgctaagagacctctttattaatttaacaattcttgtcactttccattatttatttatgcttgtgtttaaagagaatttccttaagaaagaagataccctgctcaggcaactatgcaaaggcattctttctgggttactcggtgtccttttaatgttcttctctatcaaagcaggaccagccatcatcgatttaagacatatcccccttattttaacggccttttacggaggcatcgcccaaaccatcattgcagcctttgttgtgatcattggtcgattattaatcgaagccaacgtcgcttctttcatcaatattttttccatgatgatcatcgcaactgcttcttttttaattgctgaacggcatatgaatcatgttgtgaaaatgctgttgtccattacgttaggtaatgtgattgccacaagcctatttatcttaatcgtgcatgagacatcatttgaactgcattttgcttattggatgttctcatttattgcaggattgtttaacttttacgtcattgagcatcaaactaaagcatatcagctgctgaatttgtataaattccaagctcattatgattttttaacaggtgttttaaataaacggaagttcgatgaggtcttaaatgatgctttttcgatgaaatttaagcagcctatccatcaaatgtcccttatttacttagacattgattacttcaaatccatcaatgaccaatatggacatcatgagggagatatggttttaaaagaaatcggaaaaaggctgatcaaaaacacaagaagctctgattatattggccggatcggcggcgaggaatttgcagtctttctaccaaattgtacagttgaaaaaacatggcagattgcagaacgcttacggagaaaaatagcagatcagccggtttatttacaaaatggcatgtccattcatattacagtatcacttgggtgtgcgtattaccccgggacaagtccagatatcaaacaattaccgattatagctgaccaggagctctataaagcgaagcagtctggccgaaatcaagtgagcttctcagggagaaaaagaggccaatgaatataggctttttcctcaatttgttatcgctaattatttttaaaaaagttttcgtataacagttgttttttcccgcaaacactggtaaagtaaaggtaattatttttgttcgtatcatctttaagaagaaagttttgaaagagttttcgtctttgaagtttgtgtaagagcaagaatagtgaatttaagcgttatgatcgctttaggaggaaatttcatgttagaaggtaaagtaaaatggttcaactctgaaaaaggtttcggattcatcgaagtagaaggtcaagacgatgtattcgttcacttctctgctatccaaggcgaaggcttcaaaactttagaagaaggtcaagcagtttctttcgaaatcgttgaaggtaaccgtggaccacaagctgctaacgttaacaaagcgtaatttaagagcatctgctctttagcactttatagagtgaaggaaaaccgcccggcttctgccggcggtttttttgtgccataataaaaaagagaacctgacgagaggttctcttttttatttgtccttctgctttagcttctgcaaagcagaacgatacatatcatcattcatttttgtctctggttcttcttctttgacaggtggttctggctgcttaaacttttgaagcgcctgtctatagaaatcatctccagacactcgttcatccgtttgaagaggcgttgacgcttcctcttctacttcaggctctacaggtctcgccgcaacttctgactcgctacgggccacgtcaggctgattgggcacatcttcattgatctctttcttctcgaccgaagcgtgtctaacattgaatgctactaatccgataatgactagaacagcagctactaacgctacaataatcgtcgccaaaagaaccctctccttatcgcttaaatgacgcagtgactgatgctacacgtcttcctaatgctttcccgagttcaatgccttctgtcgaaatcacttcatcagaatcaatcggacatgtcacacctgctccatagtaagagccgtataaagcattttctggcacatttccaggaagaccaacgacaagcatcccttggtggaacattggtgtaatcaaattatgcattgtcatttctaaaccgccgtgcgttgtagcagttgtacagaaaacggcaccgactttatcgattagttttccctctgcccatagatagccaagacggtcaatccatgtctttaatccagcactaatggtcccaaagtgaccagggcagccccaaatgattgcatccatttgatcaagcttgcgaatatcagcatcttttacgtgatcaacgaatacttctgcctgctctgtttcacctgcacccgctgcaattgcttctgccagtgctttcgtatggtcaccttcactatcgtatacgacataaattttcatgtacggtccctccacacttatcttgcatcttgatttgcttccttaggtgctggaagcagtgtcatttcttgttttttatgctgctgatcttttcgctttttatccttacgtacatcacgcaggaacaagctgagaatgacaccagcggcacagaataacgttacccacatgtaagcatcattgatacccattacgtttgaatcaacctgtgctttcgtaaagagctgggtagatacatatttttgagcagcttcagctgtcatgcccatatggtgcatcacattcgacacagccgcctggaatgaattcataaagaacgggtccgctgtatttgtttgatccgccatattggaataatggaatgttgtccgattcgtataaatcgttgtgatcaaactcgtaccgatcgaaccgcttatttgtcttaatgtattagacatcgctgtcccatggctgtttaagtgctgtggtagttggttcatcccagctgtcatcaccggcatcataaggagtgacataccgaatgcacgaattgcatacatgagcacaatgtgactatatgatgtatcaatagtcagccttgtaaactcgaatgtggtgacaacggtaatgagcatccccacaatcgcaagcggacgaggtccaaatttatcaaacaaaatacctgaaatcggggacataatcagcatcgcaagtgctcctggaagcattaatagcccggattgcaatgcggtaaacccaacgaggttctgcagataaatcggaagtaagaacatcccagtgtataaggcaactgtaataataatattaatgacacttgataatgagaaaatgctgtatttaaacactcggaaatcaagcatcggattatcagctttcagctgttggaaaataaagagaatgatcgcaatcgcacctacaataatcgtcgataagacgatcggatctgtccagccatcacttccagcttcactcactccgtataggagcgaagcaaaaccaacgatggaaagaatcgcaccaaggctgtccagcttgatctttttaggctctacaatatttctaaacataaagaaagccgcgataatgacaattgctccgattggaacaagtccataaaacataatacgccaagaataatgttcaataatgtaaccagataaagttggtcctaccgcaggagcaaacatcatcgcaagaccgaaaatccccattcctttccctctgttttctggagggaaaataaaaaggattgttgtcattacgagtggctgcagaataccgccgccgactgcctgaatcagacggccgatgagcatggtcgaaaagttcggtgcaatcccgcaaataaaggtccctagtgtaaacgagatcatggcaactaggaataaactgcgctgtccaaagcgtgtgattaaaaacgcagataacggaatcagcacaccgttgacaagcatataacctgttgtaagccactgaatcgtcgttgcactcacattaaattcagtcattaaatggggcatagctacgttcagaagtgtttggttcaaaatcgcgacgaacaagccggccattaaaatgatcagtaaagacaaggagcctgctccctgttttgttgctgcaggttgatttgccatctcagacaacctcctttcattttttgatatcaatcatcattaagatgaaattttgacagaagcattcataccaggaagtactttgtctgatggatttttaattgaaattttcactgctactttttgtgtcacttttgtatagttaccacttgagtttgttgctggcagcatgttgaatgttgaatttgtcgcataaccaatttgttcaactgttccttcaaatgttgtatcaggatcaccatctaccacgatgtcgactttgtcgcctttttcaatgtttttaatatctgtttctttgatatttgctgtgatgtaaagcttgcttaaatcaatcgtttcaccaagaactgtaccaggctgcacttgttgattattttgtacttcttttttgactaatgtgccatcagccactgatttaacgtttgtttttgtttctccttcaacttttgcaacagtgctgtctttttgcacttcgtcaccttcattgatatcccagcctttgatttgtccagctgctggtgctgtgatttgatacatgtcacctgttactttcgcctcgtcagttttgacaaaatttgtgctttcgtagtagtaataagcacctccggcaataatggcaagaatcacaataaggccaataatgttcgttagcaataaacgccctctgttcatgttttgtttctcctttcatgtataaaaatatagtgtcatctgctttagcaaacttagaatgcccatcatctgacagaatatgaagtaagctcataaaactgttatttccccttcatcttccccgcatgaataatggtgtgcagcccatttatacttattgttcactcatgagcaaagagtagaaaaagaagaaaagaagatcggcatcttttttgaaaaacttatatttaacaagattaaatattaataaatgaaaattgaaatgtcaaagagaaagttttactttttttctggtgatcccttccttctccatacaaaaaacccttcagcccttatactgaaaggtttttttaaatgtgctatttacgaaagaacttcttcctgctgaaaaaatttttttagggcgagaaaaacatctgatttttgcttcaaaatataatgcttaaatttctcatcctgtatatgcttatatgctgacattaatgtggaatgccggttgtattgattcacttctccataacagaataagttggcttttttcataatttcagaaacaagtttcacgcaccgtgcattgtctgaggtcaaattgtctccatcagaaaaatgaaaaggataaatattatatcgtgacggcgggtaacgttcgtctatgagctctagcgcctttcgatagacagaggagcaaatcgtccccccgctctcaccgcgcgagaagaaatgctcttcatctacaaccttcgcctctgtatgatgggcaataaattcaatatcgaccgtctcatactttgtccgtaagaaacgtgtcatccaaaagaaaaaacttcttgccatatatttttcccaaagtcccatacttccgctcgtatccatcattgccaaaacgacggctttggactctggtttggtcacttcattccacgtcttatatttgatatcctctgggtagattggataaaaggaaggactgcctgtcattgcatttcgtttaaatgctgacagcatcgttcgttttttatgaatattccctgttaacccggttttgcgaatatcgttaaactcaatttgctcgacaatgatgtcgtcaagctccttttgtttaaggtttggcagctctaattcccgaaacagcgcttcctcaagatccattaatgagacctcagcttcgtaataatcctctccagcctgatctcctgcgctctgcccctttccttgcccttgcttactgtctgatccatcacgtgcgacaatatcgcctacctcgctgtctccatcgccttgacccacatgcttatttttatcgtagttgtaccgaattttatattcatctaacgaacgaattggaattttaacaacatcttttccattagacatgataatgctctcttctgtgacaagatccggcaaattgtttttaatcgcttctttgacctttttctgatgacgctgctggtcgtcatagccttttcgatggagggaccagtcttcctgagatacaataaactgacttttttcttgccgggacatccatccccctcctcacctgtttgcactattcttctaaccaccgattcctttatcttatgctgctcgtcacccaagttgacggtcatttctaaaaaagacattaccggtgcaggtgcgccaataatgcctccttcatttattaacgattgagaagactgcctacatattttaaaagttcatttgcacttgttgaattatagccatgttcatcaattaatctagccactacttcattcactttcttcagctgctgttcatccggtgtcttcgttgacgtcgtgatttttaccacatcttttaaatcagcaaacagcttcttctgaatcgcctcacgcaatctctcatgagaattataatcaaagcgtttgccctttctcgcataagccgaaatacgaatcagaatttcttctctgaaagcctttttggcgttttcagaaatcccgatctgctcttcaattgaacgcataagcttctcatcaggattcatttcttcaccggttaatggatcacgcagcttgtttttgttgcaataggcctcgacattatctaagtaattatccatgagcgttttcgctgactcctcataggaatacacaaatgccttttgtacttccttcttcgcaatatcgtcgtactcttttcgcgcaacagaaataaaattcaaatagcgctcccggtcctcgcttgagatagatggatgctgatcgagcccttcttttaacgaacgaaggacatccagcgcattgatagattccatattcttccttataatggtggaggaaatgcggttaatgacataccgcggatcaattccgctcatcccttcatcatgaaattcctttttcatctcatcaatatcagcagattggaagccctcgacactttctccgtcatacagacgcatttttttcaccaaatcaatatcagaacgcttcggctctttgagtcttgtcaaaatggagaacatcgctgccaccttcagtgtatgcggggcaatatgcacacctgcgacatcactttctgaaatcattttatgataaatgcgttcctcctctgttaccttcaagttataaggaattggcatcacaataattcttgaatgcaaggcctcgttctttttatttgaaataaatgacctgtactcggtttcattcgtatgagcaacgatcaattcatctgcactaatcaaggcaaaacggcctgctttaaaatttccttcctgcgttaatgacagaagatgccataaaaatttctcatcacactttaacatctcctgaaactccatcatcccgcggtttgctttattgagttctccatcaaagcggtaggcccttggatctgactctgatccaaattcagcaatggttgaaaaatcgatgctccctgttaaatcagcaatgtcctgagatttcggatcagacggactaaaggtaccaataccggtccgtttatcctctgagaaaaagatccgttcaacccttacatcctcaattcgtccgccatattcctcttccagcctcatcgtattgagaggagacaaattcccctgcacacgaatgccatactctctatagaaatcctcccgcagattttgcggaataagatgaagcggatcttcatgcattgggcagcctttgatcgcatagactgcgccattatctgtcagtgaatattcttctagtcctcttttcagcctagtaacaagcgtagatttccccccgctcactggtcccatcaataacaaaatacgcttcctcacatcgagccgcttggcagcagggtgaaaatattcctccactaatctttcgagtgattcctctaatccaaaaagctcctgatcaaaaaatttgtacgttctgaccccattctcctcttcaatcccgctgtctttaatcatatgataaacgcgagaatgagcagattgagcgacaagtggattttcctttattatgtctaaatactcgccaaatgtgccttcccatttaagacgctgctcttcttctctgtgctgttcgattttctttaaaatatccatatgaacctcctctttcaagattgaagcaagtaatcagatactgttttacaatctatgcggaggcgtcctattacatgctttcgttcttcaaaatgacgaattggcaaactgaattgacaaccatccgcaagacccttcataataaaggaaaaacaggagaaaaatgatcttcttctcctgcttttcagaggcgaacttcacatcatatgaaacaggcagcgatcgaaacaaagggataagggggagcttatatgagaacggtcattatgatgggcgtcatcattacgtttttagtatccattttcacagctggctacgaaggcaagcctggtaaatgaaaaaaaggatgttccattagcggaacatccttttttcatttagttcgttgtttttagcacctgcatattcactgtatttcctgatacctgaatggacgtaaagtcttgcgtatcaatcacaggtgtgacggcacgactgtctaatgtaatgtcagtaaaacgagtagagaagttcgcacgaatatctttccggtagatatcgtcagtcactgctactgtggacagtaatttccacttcgtcacagagccaatgtttgagttttggatttccgtgatgatacgcccggtataaccaacattatttgtcccccagaacgttgctcttgtatgtccattcaagtttttgtaaatggtcatttgcacagtacttccaggcttaaatccttttgtatacgtaaagtcatttttcccttcgatatatgtctcttgattatttgctcctactttcatcgtaggtttccacacattataagttgaactgtattgaagaccaatatccgcttcctttgatcctgtgaacccagaataaatataagctgtcccatttgacacacttattgcggaagggagttgaatctttgtgaccaatatagatccattgctattgatataagtacgcccgccgatacctttcgatagttgcgctgcttctatttcctgcgttagagagagacctgggatactgactggaatcgtccccattaaaatagctgaactaatggcactagtgatcagtagctttttcatctcatttttcctcctaatggattcattttttgaaaacgttatcacaatctatcatactacctatttttttacatgtcaaaaaaagtataaaagtgtcgtattttccttctttttgtttcttatttcatataaaaaagccgagatcagtatcccggctttcatgatgaccttaaatcagatcacggtattgctgctggcgaagtgcctcatacacaagaattgctgccgtattcgatagattcagagaacgaacatgttctgtcatcggtaaacgaagacagcggtccatattccgctcgatcaaatccttcggcaatccacttgtctctctgccaaaaacgaagaaatagtcttcatctagctgagagtaatcaaatgtcgtatgcggcttttgaccaaattttgtaatatagaagaattgtcccttcggatgagcctcaaacaattcatcaagcgagtcatgatagaccacattggcatatttccaataatcgagtcctgcacgcttcagcattttatcatctgtcgaaaaaccaagcggacgaatcagatgaagggttgtatttgttgctgcacatgtacgcgcaatatttccagtattagctggaatctctggttgatataaaacgacatgaagtcccaaaaaagttcacctctaattttcttttccgctcaacattataccattaactatcctttgcggcatcgtccaaaatgtgaaaaaacatataacgaatagctggtgtataggcggtcgaatcctcatacgaccaataacgcatacggctgtcatatgtctgagcattcacaagaggcatcccgcctttatcgtgatcgacgacaatggttgtatgattatacctgccatctccctcaaaatcgtagcaaatgacatcaccaatttgtagctcctgcgcttcttttagtttctttgctcttaaacccgctttcgaattcgctaaataatttttcatcgaatgagctactgtccagctatagctccacgtatgtggcctcacccaccagccagatccacggttcggatatcctctcgttggcgcattccctgcctttaagcattgtgaaataaaatttgtgcagttatcttcaaaatttttataggcaggatttcgtttattccagtacgtctccgcatattgcacggctgcccgccggtcatagtgaaaggctctcccaaactgttcttcggtctgaaagcgctcatccacttgctcttccatttgacgttcttctatcatcaatcgatcttttacaagcatgtcgttgtaaaggaacgcttctcttttttctacctgttcctctaaataaaaagaatcgtctacatccttgcatacataagtgagatgagcgagatactgcacatgctgagcaccgtcatcctgaatcgatgaatctaggagtgttgctttggctttcgctttgacaatctccacctgtcttctagcaaaaagctcttttttccgttcgactgcttccacatcagacatcagctgcggctgtttgattgcactcccatttaataaataaccaagcctgtcttctaatgtttgctctaataattgtttcacacagacaccaccaaactttttttaaaatctctgtttggttcattctatgttcatagggatgttatttagtatttaaaggtgtctgtaaaagatccatccctttaacaatttcttgtttcgcttcttcatcactttcccgctcaatggctttttccagctctgggagcagctccacatcaccaattttccctattgcccaagcagccgtgccccgaataacaggccgtggatccttgtgcatcaaatcaatcaacacgggtaaggcagatgtatctttaaagtgtgcaagtgccaaaatcgcatttcgctgaatcggctttttcccccgccatgaacctgaaacatgaccgtatttttccttaaactctcgattactgatcgtaagaagcggctttaagagcggcttcgcaatttcaggatccggctccatttcaggatgcaggtgaaagtccttccctttattgatcgggcagactatttggcacgtatcacacccatataaacgatttcctattttcgaacgaaattcgtcaggcaaaaatccttttgtttgcgttaaaaaggaaatacaccgttgagaattcagttgtcctggatttacaagtgcaccagttggacatgaatctacacatttattacacgttccgcactggtcttcaattttttcatccggttcaaatgggacatttgtgatcatttcagccaaatacacgtaagacccaaactctggcgtgataatcatacagttcttcgcactaaaacctatgccagcacgttccgctactgcacgatcggacagttcccctgtgtccaccattgacttagttcgtatatcggcatgtttgcttcgcaagaattcttcgagcatatcgagcttttttttcagcacaacatgatagtctgttccccaagaagcacggcaaaagatccctcttcttgcatcctttgtacttcgaggagcatctttcattttggaaggatacgcgagcgctatcgcaacaattgatttggccttcggaagcagcaaagaagggtttgttcgtttttcgatatcaggctcttcaaagcctgacaaataccctaacgattcatgtaaaatgaggcggtcttttaatgaatcaaatgtatcagcacttgcaaatcggattttatcaacaccaatttctttcgcatattgaatcaattcttcttttaattctccaacatgaatcaccttgcaaacctcctttctttgtttattctattgttttcagtataatacgagtgtatcatgaccgattggagtgagtcactgtgaagatacatatggaaatttctcatcctgaaaacccatctatccatgttggacagattgaatattcgcatattgaagttggcacttccccgcaaatgttaaaaggtcggctccgcctgtttcaagaatctttattttttgaatacgaagataaagtcttagaagaagtaccagcaatcaaagaatggatggatcttttaaaagacatccctttcttgccaattcttgctgatatccaaaaggaacaatttattgactcgaccaattccgtacaggatttgtcgatctttttctctttaaaatatttcttgcctatcctgacattcgatgctgatcgaatagaagagccgctttcactagcaaaacatgagagaggtcacattgaatggcaggacaacgtaggacttaagggattattttctcaaccaagtaaagctcacatttctcaagacacaaaaaacattttgcaaatcatcctgtttccgccatctatttcccgggaaaagagtgaagctctcattcaatccttgacgaagatgtttgtacaaatacatggtggagaaagtaaatatgaacttattgaaaaagcactgtagcttgacagtgctttttcacattatactgacataataaaaaacgcaacacttcgtttatctaagaaacgaaatactgcgttataaacaaaattatgtattggagcgggtgatgagaatcgaactcacgacatcagcttggaaggctgaggttttaccactaaactacacccgcatcaatttttaaaaagcaacgtcatcgcgttgacttttattatgttacaactttcttaacaattcgtcaagagaatatgaagatttttcgtcaaaaaacttcatattctccgtatatattacgatagttatttatcgagctgaatataaaataagtaggcatgtgacttattcttcaacgcttgcttaggattttcctcaatcttttcaagcatcggtgaatttccgtctttccccattgccgctgtgtacgcaatcagtgcctttcctccagaagagactttgacagtttcagattgagcagagaaaacatagtcacttactttgaacggaaagcttgctgtcgctttcgtcattccctcgttcttgttgtctgaccacatactaaattgtgattcatatgtatctttctcatgtcttaattgtaagagcacattcatcgtttggtcggttccatcctgatgtaaagtaaaggtggcagatgatgcttccttattagctaatcggccatttttataatgactcccgataaacgtaatactcttatccttcttcgttaatccttttattgttaaagccaccatttcattagtggttgatgcttctagtaagctcttttctttttttgtcagtttcatttgttcaatggttactttctttttagtagactccttgtttattgtagataccgtcttctcggtttgcgtggtttcttcggccttctcgccgcatcctgctaatagaaaaacagtgaatataagaaaactccatttttttaacattgagatcccctttgatgttttttattttctattatactaaaatttggttttacatacaaaaaaagattaggagaattctcctaacctttcgcttttttctgcttcatggctgataagaaagccacaatgagaaaactcgcggcaaaaatcacaatcatataaataaaaaagtttggcttgatttgaaaagtaaatgcggatgaaccttccatctcaaaagcgagactgttaaataataaagcatcattcgtttttgattgaaataaatgataaaacaatacaccgattgtcagcatcggaaagcctaaaaaccccaagaaaccaccaacaatagcaccttgtttcatcgcctgtacgttcatgatcgttgtcctcccattcccccaagcaatagttgcttcataatggatttaccatcccccataaacggaagaagatagagtaattgaataaaatacgtgattgaaaaaataaagaagcctgttgaaattggattttcttttagacataatacggtcacaatgatccctgctgccccgatcacacctgggacaagcggcccaagcaaggtaatccatacctgctttttctgaaacggatctaatacgggtctcacaaatttcacagacatcatatcactcgcaaaaaacccttgtggaccatcccgtcccgcaaatttccgatgcgcatagccgtgtgctgcctcatgtaaggcggtcccggtaattaatccaaaataaataattgtaaaataaatcgcaatggctgcaatcgaccggtcaggaatgaataaaaaagcgagccctgccatgaccataaaaagcatccagaaaaaaatgattttacgtgtcaccatgagcaatgctgtcccaaaaatgtgaaggaacgagtgaccagtgcaatcaaatcgttccttcattttcacttgatactgtttaaaaaattgacagcaggctgttacaatccgatatggtgattgataatgaatagacattaagtggtgctgattcaaccccatcatcagttgataaaagtcacgagaaatcacagactcatcgacctgaaacaaatcagcgagctctgcggtaatactcgcttctgtccttttgccatctactttcgttagcatatgataggcactttcattaatcgggagtgtgcttccatactgcgtatccgtgagatgcctcttttgtaaggtcacatacggcgcaagtgccggtacccgctcaatctttagcttattgttaagaagttgaatcatgtgaatacctccatgaaaaacctttgtatatggcaaagatgagcagaccttcaaatgcagctacaagcagccactgaagtgtttgactcgactcccctatgacatagtttccaataaaaacaatcggaatcatgagtaaaataagtgctccaaatgaaaaaatgcctgtgtaaggattgttccgatcaagcggaagtaaaatacctaccacataaaagagcgcagtggcattgcataagacagcggccccaatcaatacgttccaaacctgatcaggaagcgtcagcgttgtcagcataaatattgcaatttgcagtacaccaacaagcaaaagcccgataaacttatacagagccacttcccaagaccttaggccaaacgttttgtacatccccagcattcgtttatcattgccaaatgaattaaaggcggttaatccagcgagagcgaagagaataaaaaatgcttcttcttcaaagcggaatccaaattgataacggacgaataagatcacaatgaggagaatgagaaagtttaaaatgttttcttcatttcgcacctgtgatttcatttcctttacaataagtgaccatttttttgaagaagaaaatggcagcttgtttaaaaaggttaacgcttttttttctgccataatcggcatcatcgcaagagaaagaaaggcgccgcccgccgataaaaggataaacagaatcaaaattacatagtttaccccttcaggagacattccttgagccgctaagaaaaacggtgctgtaaaatacatcaaatgataatcaaactgtatatatgattgctgaatttggctgatatcaaagtgcgtcattccatacgccacaactagtgctaataaaacaaagatcgctgcaaatttttgcaacggtaattttaatttcagtacgaccaaataggtcatattataaatgagctgtaaaagcattaagacaaaaagcgattgcaaaatcaccatcaaaaagaacgtaaagataaagaaaatacctattccctgggcaataaaattaggtagcagcagaataccgataaaaaataaaacaagccctgccaccactgtcaccatcgggataaagtatccaaggcttttctgaaaggtagaaagcgggaaccagctgagctgcatagaaaaacggtcttgctcaggcgttctgaccttgatcaaaatgaataataggcttgtaaagatggatgcattgatcgccattgatacaacaagtaatccaagtgaacgttcatttccatttaagaaagccttcataaagacccccgtaaaactatatccgatgatggcgcccattgtgacggcaaataaaaagaataagatcacaataattcgcttcgtctgagtatcaaagagcttatacatctcctgctgccacattttaagcatcattctagaaatgattaatgatttcatcaaaatgtgcacccctatcacttaacattgaagctttcagaaacacctgttccaatgtgcttgattgatatttctcctttaaggctgagaccgttccttcatccattttatttcctttagaaataatggcgattttgtggcacagctcttccgctgaaagcatatcatgcgttgaaagcaagatcgcaccatggtgctcggcataacgcttcatcagtttctttgtgtttataaccgcttcaatatcaagtcctctaaagggctcatccatgatcaccaattgactatcaagcataaaggcggcaatcagctgtgtcttttttttcataccatgtgaataggtttcaatcggtcttgataaagccgagtccatatcaaacagttcaattagttgatttcttctatgaattgttttacattcatacatagaagaaacaaaatctaaatattcagcaccagtcaatgcttcaggaagcagcaggtcatctggaacataggctacttgttttttaaaggatggttcgtcatttgtctcgtcctgcaacagaatcgttccttctgtatgcttaatgatgccgagtatacagttaatcatcgttgttttaccggaaccattcggtccagcaacagcaacgatttgatgaggggcgatctttaaatgaaaatcattgacagcagtcacgttatttttatacgtcttggttaatttctcgatcgtaaacatataacctccaagtgtctgcatattctttaaaaacagatcaggctaaaccgcccgccacagacggtttagccctggtgtcatttcatagaagtaaaaagatgaatcctaagtatagctacttacattcaatttggacttttaagccactttcccactgaacggctcctgtaaagctacccttgccgtttgctaaacaccaaactgctgctcctagaacaactgttgctcccaatccaagaaggacagcaacaaatactaagaaccaagcttggtccataatagcaggttccatagtggaatagtcaacttgcggcgctgcataagtcatacttttcacctcccagcttatgatgatcgtatcataggcttcactctccaaacatcaacagaagatcccatttttgaccaaacgtactttcgagtaaaatgtgactttttattcaattcttcacttttaagtgtagaaaccctatcttattatctagattttcccaccccttaagaaccacaaaacccatataatggcaatgaaaccatcttttttctcccttttttgaaatagtccttatttatcaatccctttatatatgctttcttttttgtgaaatagaaagaattcccccgatatatcagataaaaaagtcctgattatatgtcgttaaaacactatttatgaaatatttactgataattccgacaaaagagtgagcctattttccttcttctcttgtcacttaaaatatgtatatacaagaaagcccattgggaaaaaagccctttcttttcttgagtaacatccaacatatgattcgcttctttctatgataaagcaacttacagcataggcattccaatgacttcactagctgtactgctttcaaaaaaaactgatccgtactctctaataacacaatctctcttttcctcagcatatctacaccctttctcattgaaataaaaaaagcccatcaactttattgattattttttcagatttatctaaaaaatgattgaccaagcatgaaacaagttttatagtcatattaaatatttcttatcaaagtagttggttttatctaacaaaaggaggatacacacatgtcagaagaacgtccattccgtttagaaacaaaagccattcacgcaggtcaggagcttgattcagcaacctattcaagagccgttcctatttaccaaacaagctctttcggttttagagatagtgagcatgctgcgaatttattcggactgcaggaacccggaaatatttattctcgcattatgaaccctacaaatgacgtctttgaaaaacggatcgccgagcttgagggcggcattggtgcactcgctgtctcttctggacaagcagcgaccacttattctattttaaacatcgcaggagctggtgacgaaattgtctcctccagcagcctatatggaggcacgtacaatttatttgctcatacactcaaaaaactcggtattacagtgaaatttgttgattcatccaatttagaagaactcgaagcagcgattacagacaaaacgaaggcagtgtatgcagaaagcattgggaatcctaaaggcgacattctacatattgaagccatctcagccattgcacacaagcaccatattccgcttattgtggataatacactcgcaagtccttatttattaagaccgattgagtttggtgcagacattgttgtccattccgctacgaaattcattggcggtcatggtacatcaattggcggtgtcattgtggatagcggcaagtttccttgggacgacagtgataagttcaaagggctgactgaaccagatccaagttatcacggcctcacatataccgaagcaattggagaagcggcttatattacaaaagcacgtgtacagctcttacgtgatttaggagcagccttgtcacctttcaactcatttttacttctccaaggcttagaaactttgcatctgcgtctcgagcgacatagtgaaaatgcgttaaaaacagcgcaattcttacaagatcatcctctagtagattgggtaagctacccaggacttgaaagccatgaatcttatgagcttgctaaaacctatttaccaaaaggacaaggcgccattctcacatttggtattagaggtggacgagaagctggtaaaaagctcattgattctgttaagctgttctcacaccttgcaaatgtgggcgattctaaatcactgattattcatcctgccagcacaacgcatcagcaattaagtgaagcagaacaaaaagcgacaggtgtcacaccagagcttattcgtttatctgtcggaacagaagcgattgaagacattattgcagatcttgaacaggcgatcacaaaaagccaggctgaatgaaatagaaaaagcacacctcagtgtgctttttttatgtgtcattaatcattaagtagtcgaatgtcttggaaaggataaaacacaaatgaagtcgttccttgaatatcactctttgtaaaaagacctaagccattgcggctgtccattgagttttgacgattgtcacccatgacaaaatacttgccttttggaacggtaagagggccaaaatcaggtgtcagcaaggtcccatctgcagctgctttctttttgtttgacgctaagtaaggctctgccactttttgaccattgacatatagctggtcatttttcatttcaattttatcaccaggtaaaccaatcaaccgtttaacataatgagtgctgcggtcttccccatcaagaacaatgatctgtccccgcttgtaatcaccgaagtaatcaactgttttattcacaaaaacccgttctgtatcatgcaatgttgggtacatggaagaccctttgacaatgtacggtgcgaataaaaagttacggatgataaaaacagcgatgaatgcgattaagatcgctttaagccagctccatacttctgatttctttttttgtgttgttgtatttgttgtcataagctcctcctgaaatcccctaggacgaaatgcgttacaccagctacacgccagcatcacgcttgtatcaccctaaatataaacatattttgccaacaaatcaagcgatgagagagaaaaaggcaagcacccttctgtgcttgcccaaaactcagttacttagcagaagaatcatcttctttttcttttgatttaccatagaaataatcagatggattcactggtttaaaatcagacagcttgtggaatcgaagaagatccctataaagcactttatctgataggcttaactgattatcgacacgggctttaattgcctctgtctttttattttgtttcacaactttacctgtttttgtatcatagacagtgttatctacaagtgtatattttggtgtcacatagtttccgttacggaatgcaacagtttgatcatgcttcttagagaatagatctgttccaaaatttacatactcatttgaatcaataccttgtaagtgaagaagcgtaggcatcacgtctacttcaccaccatacgtatggttcacgccgccctgtttgccaggaatacgaatcatgagtggtacacgctggttttgcgcattttgataaggtgtaatttctttcccttgaatttcgctcattgcacggttatggttttcagaaataccgttgtgatcaccatataataaaatgacagagtctttatacatacctgattttttcaagtctttaaagaattgctctaatgattcatctagatatcttgctgtttggaagtagttatctactgttttgtcaccagttgttgccttagcaatcgtcgcatctttttcatctaaattaaatggatagtgattagtcaatgtcattaaatgtgcataaaatggctttttcattgattctagcatcgggattgattctttgaagaatggtttatccttcagacccatattcacaaaattttcttcatccatgttgtaatatgaagcatcgaagaattgatcatatcccatatgcttataaatcgtgtcacggttccagaaagatttatagtccccgtgaagcactgcgctcgtatagcctgctttttgatctaggatggcagggagtgattggtaagtgttttcaccttttgttacaaacgctgctccctctggcaagccgaacatactattatccatcatcagttcagcatcagctgtttttccttgacctgtctgatggaagaagttatcgaaatacgtaaagtcctctttcccatgagccagcttatttaaaaacggtgtcacttcttctccatttagtttgtagtcaattaagaaagactggaagctttctaaatggattttaatgatgtttttcccttttgctttaccgaaatactctgcgtttggcttcgcatagtgagaagctgtatagtttacaacatctgttaaatcttcactgctcgcatttgctacctgtgttgcattttgtgctgattgtactccgtcataaatcgtataattataaacacctaaatatttaacaacatacttatgatcaaatgttcttgttaacaattctggacggtccttttcagctaaatgaaggtttacgaagaacagtcctacacctgcagccacaatcagcagtgcaaatgtctttttcatttggaatttcttcacttctggtctccaaatcacaatcgcaatcaagatcataatatcaaggaaatacaaaaggtcatgcggcttaatactagataacacaccgccagtcatgcctcctccaagattgcctgcttgcttcattgtggagaaagtcaaaaagtcatcaaagaaacggtagtacgctacattcgcatataaaagtgcggtcataataaagtcaatcacaattaaaacaatggcagatttacgacccttcaaaaagagagccagtcccaaaaacacaatggctgaactaaatggatttaataaaagaagaccctcttgaaaagaacctttcactcctaaattaaagtccattttgtaggctgcatacgatttcgcccaaaataaaaggacagccaatacaaaaaagctatatttgttcgcaaatatttttttcataaaacctcttctttcttattatcgttctgatataaatgaaatcataaaaaatttacattgattttgcaaatgtaaatcttcttcaccaagcattccgatgctctgtttccgccggatatgtgtgctcctctaatataacgtatgagaagcattataggtttcaaaaaaaatacgagtaaataaaaggaaaaatatccatttacattttatttacacacactttgcaattcaatggatgaagaagggtttgtaaatcactcagtactactttacttttttcatctattcgtgtcaaagtaattataaagaaaaggaagaatcacctaggtctttcgactctttcacctaaatttatacaaaatttgataacttccagccatccatgtattttctctccttctaacaatctaaaaaagttttaagcaaaaaaagcttgatttctcctcctcatatgcggtgtgataaagatatagattttcaacaaatcaggctggaggacatcacatgaaacataacaaacaaataaacgcatttgaagaacgattttcagaagaaatagaccacatcattgctgtcacaggaccctcaggagtaggtgcaggaaaagccggacaggaatctctttggaccgcttctattccactgattgcatggaaagataaagacctcatcacaacagaaaacataagactctgctggttaacagatgaagagggattaagggaaaagcagacacaattacataaagaatcaatcgtgacacttcaggtccgaaaaggcgaaggtgagttcatgcttgtatcactcatcgatacagatacacaggatgaagagctgcaagtgatactagaagaagcccaaaaacctgttttttttcatgatgacatgctgggtacctttgaattagtgaaaggactagacttatttgaaacaacgatccagtggagtaatgaagagtgcctgctctacttcaacctcgaagaagatgaaaaagtaaacgactctcttcgaaccgctagacaactcatgaaagagcagactacatgggatgcttctattaaatcatttgcagcaaatcagctgcttgaactagctaaagactggcaggcacaagatgactccgctgaaacacaagaagtacttacgctggatcactttataagccgaatctcactcgaaagcttgcatgcctacccagatggagagtttgaggtctactgtcatgacggtgatttgttttggggacatgtcattattgtctctggcaatatcaatggcacctttcaagatgcccacattgcaggctaacaattggaggggtaagtaatggagttcaaagcttttcatgaattaaaacaattagggaaaacacccatcgtggctaagattggtggctttcgtcctgatccagcagcatacagctggtttgccggtcatttcttcatccaccctgatcaaggctggcccatagatcaagatggtgccatgattccaatcttacaaattcatttacctgaagtgccaggaggattaaacggattcaatgaatgtcaattgattcaaatctttctcaatcagaaagcacttccgatggatatcacaaaaaacggcgaagggtggaaactcattgaatattcaactatggatggattagaagtagttgagactcccgaagaagtgagaggactaaaaccctttcaaatccaatggaacgaaaatgagcaaaaggacttcccctgctgggaagaagcttggtcatatgttgatttatcagaagtgaatgaaagtgatgaagcgacagaacacttctttgatcaatacacccattattcgttcacaaaaatcggtggatatggagcatatattcaatccccaccccatcatcaaccaggcgagttcatgctgcaaatcgcctcagaagaaaaacctcggtttatgattggggataacggcacgatgtatttctattacgacaaagacacaaaagaatggtttatgcattgggattgtttttaacgttgtattgaatgaaaccttccctccttctaagcgtaggaaataatatggaaggaggaaccaacatgggattcatttttgatatcttctcactagctgtgtatattccttttctacaggtagatgaagaggatatctctagcaacgaaggcgagctcaaaaagtatagctggtttcatgcattattaaatgatccagcttacagacaccttatcatttatcatccagatgttagacacgtcattggcagatgtcacacagataaactccatcgcaagcgatgcaacttaaaatgcgaacgtaaattgctgaaagctttacgtcgtgctatgtaaatatacaaaaagagccgcactatcctatgtggctcttttcatatatccttttgaagaaaacatttgacgcctggacaactctccccgtatattatgtataaatccatctttttcatagaaaagggggcttcacatgcgcttgtttaattattggaaaaaaaagcagccaagacagcaggtcaccactgaaaaacaggaagacagcatcccaatcaacttctccgcacttccctttggctcagacaccatagatgattttttgttcaacttagaccttacctcgaagctcacagatccctataaagaaacagacccgaacaaatgaacctatcctcatccaatcccggatgatttttttatattcgatgaaaggtgtggcccatgaaaacatattatatcgcgagacactgccaagcaaatggacaatccgaggatgcgtctttaacgccacaaggcatcgcacaatctcacgcactagcagagttctttaatggcattcacctcaatcagatcatctcaagtccctataagcgagcactccaaactgctgatcctcttgctcatgcaaaacaactcgaggtaaaaattgatcaacgtctcgctgaacgtgtgctaagtagcaaaccaatggacgattggtacgagaaactaaagctcagttttacggacttacattcgacttgtgagggcggagaatcaagcctcgaagccatgaaccgcattgtagaattactctacgaacaaataaattcagaaaacgatcataccctatttgttacacatggtaatcttatgagcctgcttcttaaacatgtcgatcccatgattggattcaaagagtgggagaaactaagcaatccagatgtctatgtcctgaaatatgttaaaccagatcatatagaaatagagcgaatatggcataaataaacggcagaatgaattctgccgtttccttatctattgttgataataaaaagcctctacccactcatacggcttcttacgctccgcacaccatttcatgaagcctcttgtctccgtttgctgaaatttcttccagtctgataaaagccgatcataataggctacttgtttttcaacattagtgcgaattctcttatcttcgatcagcatcatgacatcttcaataccttgaattcgctcttggtctttctcatagatgctcaaataaagatcttcatgtatatgatgaaacgaataccataaagacgataaataggtttcgcatatttgaacaatgacacgttgctctttgctgcctccaagctctagtgccttcaataaatagggcagcccttctccccgatgcacaaacaagccctgccagcgatacggcctcacatccatcggatcaactttctcccactcttgcagaacaggctgaatcaccccaatgatcaatggatatacaagcaaatgatgtccatcctcaaaccgttcaatcttttcaaacagccaagcaacaaatgaacgccgtgctgcaaattcgttctccttcatttcttcaacaaaagtctgaagaacctttaacgcatctttacgcagaccctgttctttcttcacacagtactgtctaaaaagcggaaaatcatgggatccctcgtcttcaatgatggtctgtaatatcgtcttcatttgcaagttaacaactccgcctttttacatttattctatttctcatttatctttgaatcataaatctgattccttaacgctgatttacccattctaaataacgcctttgaatcacttttttgattttatcgtagttctcccaactatctttaacataatatacgccttcagcttctggaaatgtctcctcgtagtcatctaaatataaaccattatcaaaatcgaaatattcttgggtaaattcatttccctcatcattcagcatatcatttgaaaacacaccatcacagtccatatagatttgagtccctgtcacttctcgtgatttaaatttttgaatttcaccctcaatgtcttcttcaaattcttcactgaacaaatcattatcaatgatccaccccaaaaacatgcctgtatgtacaaaggcttgatcaatagataagtcctttggaaactccccatcataatgatattttgctttatcataaacgactacttcaaacagcatttcctgctcccttcatttcttctctatttcaaaaataactttaggtctaggtaaagtcaatcttatttaagcgtgattagagtggtataaacacctaattgttctttcgctttagaaagcccctagtatccctcaaacccattcttttctatgttcatgaatgaattgtatgtctttttgataatgctcaaggtgcccctcatcaatcattttttgaaaagctatatccccgtcactcgcttttcgtttcatgtactgacataacccttttaaacgcagcagcaccatctccacataatcttctgctatttcctcaccataagcttcaaaaaacagtttgaccctatactttatatggcctgcatgttctattgaatgataattcacgatctcccccttttcagtgcgaaaaaatctactgagaggcacacatgtataaagggtataagcgatatcccaaagtcttggaccaggagcagctacatcaaaatcaatgattcccactggctttttatctttgaaaatgatgttgtacatcgcaaaatcattatggcacacaacctctatgttgttaggcgtattgtccattcgttcccaatcgtctgaaatgggaaaatcacaaacagcatcatgatacagtctaagcattctcgctatttcttttaaggcatggtgagagcacatgtattcttttaaaggatcatgaccagctacgccttcaatgaaggacaagatctctctaccttgttcatcaacccctaaaaactttggagcataggagaaattctttttttctaaatgctttagcagctttcgtgtattgatattgtctgaatttacttctcgacgaaccgtatctcccgaacgatatacgttcgagacatttccacctgtcaataactcctcatgatcattttgttttttcataaattctcccctcaaactgggtcacaatgatgatgtcagctaaagatgtgtatgtacccacaaatattcatttagttatacaaaggtagtacactgttttatgtgaatgtgctgcctcattttgtatccttacatggttaaatgtatcttatcaaatgttgcaaatcatctaaagattattctgctaaaagaagtacatgctcattcttttctaataggtttctattttttatctaaataactcatttaaaccacaaaaaaacgtttcaccacgagggtgaaacgttagattgacgggaaaaaccaatcatgaaattattaatagataccggtggccggggtctaaccggcactccgagataaattattccaaaaaggcaaggtataccctcttcaagtaaagcacccgttaatgaaataaaaattaaagttcttcttgatatatttttgattttatcggctttaaactcaaaggaattttaaactcatgaatactttcaatatgattaaaaaaatgttctatatcgtcataatccattgaccattcttctaccacctttaacttttttaactcgtttgttggtttaaataaaaattcacagtgtagttgttccatgtgagaataatcatcttcttcataaactgtaaactgacgtagaaagtcaaaatgaaatagttcctctcctgtaaaatcatagaaaccacactgaaataaaatttctttatcttcttcgctctcaactgtctcttttgaaaaagccttaaatgtttcccaaaccttttttatatcatcggtatcttcaccaatgctatctttaagataactttcagcatttttaaccgtaatcatttcaacacctcttatgtacaatttatccaatccttcttcaattagcctgcccctttattttaataataaggtaactatcaataaagtaaaagtcaatctccttagaatggcccctcagtaacaaccattttttatcatctaatgcacttaaactggtatgtatatttttcaagtactagacgaggggattatataggggtgcctccccatggtggggtactgtgggcttactgtggttcggtgctaatttcacagggtactagtgtcctcttataaaaaacaaataaaaaacgccctcctacagtttgtagaaagacgtttaaacgttgatattccttaattcttctgtaatggacgataataaagaatatctaaaattagataccggtggccggggtcgaaccggcactccgtgaggaacacgattttgagtcgtgcgcgtctgccaattccgccacaccggcatgatcattaaagagcgcaacttatgataaaaaacatggtgccgagggccggacttgaaccggcacggtagtcacctaccgcaggattttaagtcctgtgtgtctgccaattccaccaccccggcagtcttttcaaaaaggcgacacccggatttgaaccggggataaaggttttgcagacctctgccttaccacttggctatgccgccattattggagcggaagacgggattcgaacccgcgacccccaccttggcaaggtggtgttctaccactgaactacttccgcaaatcaactgggctagctggattcgaaccaacgcatgacggagtcaaagtccgttgccttaccgcttggctatagcccaataataaaatggggcgattgatgggaatcgaacccacgagtgccagagccacaatctggtgcgttaaccacttcgccacaaccgccatagatgttatgaatcatattaagaaaattggcaggggcagtaggaatcgaacccacaccggaggttttggagacctctgttctacctttaaactatgcccctatgaaaataaaaatggtggaggggggcggattcgaaccgccgaacccggagggagcggatttacagtccgccgcgtttagccacttcgctacccctccacatttgaaaaacagtgccggcaagaggacttgaacccccaacctactgattacaagtcagttgctctaccaattgagctacaccggcaaatagtgtcgtctctcagaggcgactttcttaatataacatttcgacgctgtgtgcgtcaagtgttttttagaatttctttttgtcagcttttctcttttcaaagcaacttggttgctcattagcgacgtataataatataccatcataatattcaggcgtcaatatcttttttcacaaaatatcctcgatggtagattttttgcccctttgtctcaatcggctccacttggacaattcctttttccacaaagaaatcaatcatgacgctaaggtcaggcgtgaaatacttgaggtcaggatgcgcgagcagctcgccaaaaagccatatatcttgctgttccatgacatgacgcaaatgagcggcaccaatttctgcttttgaatggatcaaaaagtcatttgctaaaaataaaagttccaaacgcttatgaaggctttcgtggctttcaatgagttctgaataaagtttataaacttccggttccatatgtcgcacctgattccaaactgtcacttctggatggaagcctttatcgattacttcaatacgtgccaaatgatgcagcgcatgcacaattgaattatatgcatcaaggaattgatttgactcaaaaaatgcttttccttctatatatctgcgaattagcttgccgtattctaaaccgattttaagtttgcggtttgaaaatgggaatgtactcaggtcatcaattaagttaaaaatatattcatttcggtcaaataggactttcccattcaaaatccaatcaatgattcggcggttcgtgccaagggtaatccattccttcaactgctcatctgtgacaacatttaaagaagctgtttggtgatcggattcatagtgcttgataaataacggctcttccgcttcttttacaatgactagaagtgctgcatcaaagttatccgtctcagaagataccttgtgtcttctttctactataatcacagccaatgtgtctggatgacttgctctctcttgataaataggacggagaagattttccatagtgattcctccaatactcgggtgtaaagttcttctctaatgctatgtatttctcctcatagaatcaaaattccttcaattcaagaaaaaagatcattgaaccattataagcaatttattcacaaaactctataactaattcaaacggaaaggtaaaatgtgctatattggagacaagggggactagggatggcgaaatactccagtaagattaataaaatcagaacatttgcacttagtttggtttttgttggctttctgatcatgtatatcggtgtgttcttcaaggaatcgatttggctgtcgactttctttatgctgctcggcgtcttatcgatcggattgagtacagtggtttacttttggatcggtatgctttctacgaaggcagtccgtgtcgtatgtccaggctgtgagaaggaaacaaaagtgcttggacgggtggacatgtgcatgcattgcagagagccgcttacactcgatccagcattagaaggcaaagagtttgatgaatcctacaatcgaaaaaagtcataaaaaaagctgaccatttaaccggtcagctttttcattaatgattttcttttttcgcacattcttgacaagtcccatagatctccaagcgatgatgactgactttaaagcccgtcacatgggatgcaagctgttcaacttcatcaaggccaggataatgaaagtccactatttttccgcagttttcacaaatcgcatggtaatggtcagatgtcgcaaaatcaaatcggcttgaggaatcaccgtacgttaattcctttactaatccagattcccggaagactcgtaaattgttgtaaaccgttgcgacactcatatttggaaatttaccttcaagtgctttatatatatcgtccgcggttgggtgagtcatagaatttacgagaaactccaagatggcatggcgctgcggagtaattcgaacaccggtttcttttaaagcatctaaagcgtcttttagttcgtgagcagccatttcatcatgcacctctcttcaaaaatattcttatattataatctttataaatagtgtacccccagagccgaatctttgtcaattacaatcctcttttttacctattcttcttcacaaaaaagaccggcatgtgtgccggtcctatcctgtgatgatattaagcgtgagcttttagttcctcaagcgcttcttctacgtggtctttcaccttaacttttctccactctttcacaagcgttccttctttattaataagaaacgttgaacgttcgatgcccatgtattctttgccaaagttctttttcagcttccatactccaaaggcttcagacaatttctgttcatcgtctacaagaagtaagaacggtaaatcatgtttttctttaaacttttgatgcttgtcctgactgtctgggcttacgccgataatgacagcatctaattctgcaaagctttgatggcgatcgcggaaatcacatgcttctgttgtacagccgggtgtcatatcttttggataaaaataaaggacaatatgttttcctttaaagtcagaaagctttactttctccccgttgtcaccggttaattcgatttcaggtacttgctggcctacttcgattgtcatgacacaatccctccaacctattttttaaatagcctatccaattttgagaggatattcaactaaggacgcttgcattggcatgttaaaataatgatagacgacgtgatacgttgagataggaggctatttatgaaattcacagaatcagaaaaattacatcaagaggcgctggagcatattgttggaggtgtcaacagcccctctcgttcatataaggcagtaggcggcggttcacccgtggctatggaaaaaggagaaggcgcttatttttgggatcttgacggtaatcgctatatcgattatctagcagcatacggccccattattacaggacatgcccaccctcatattacaaaagcgattacaaaagcggctgaatcaggcgttctttacggaacgccaacgaagcatgaagtcacttttgctaaaatgctgaaggaagccatgcctgctttggacaaagttcgctttgtcaattcaggtactgaagcggtgatgacaacgattcgtgtggcacgtgcatatacaggcagaacaaagatcattaagtttgccgggtgctatcacggtcactctgatcttgtacttgttgcagctggctctggtccttccactttaggaacccctgattcagcaggcgttcctaagagcatcgccaatgaagtcattaccgttccatttaatgatattgacagctacaaagaagcattgggtcgatggggcgatgaagtcgcagctgtccttgtcgagccaattgtcgggaacttcggcatcgtagaacctaaggacggtttcctgcaacaagtcaatgacctcactcatgaaaagggcgcacttgtgatctatgatgaagtaattacagctttccgctttatgtacggaggcgcacaggacttgcttcaagtaaaacctgacctcactgcattaggaaaaatcattggcggcggacttccgatcggtgcttatggcggtaaaaaagaaattatggagcaagtcgctcctcttggaccggcctatcaagctggcacgatggcaggaaatcctgcatccattctttctggtattgcctgcttggaagtgttaaaacaagatggtgtttacgagcgtctagatcagcttggcgctatgctagaagaaggtattttagcccatgcaaaaaaacatcaagtagatattacagtgaaccgcttaaaaggggctcttactgtctacttcacaaaagaaaccattgtgaactatgagcaggctgaaaatacggatggcgaaatgttcgcccgcttctttaaattaatgctttcgcaagggattaacctcgctccttctaaatatgaagcttggttcttaacgatcgcacatactgaaaaagatatttctgagacgctacaagcagtagatcatgcgtttgaacagttgaaacaatcataatacggtcaaaaacaggcgtaaaaaaatgcgcctgtttttttatttatcagctcttgtttgtcaaaagcgtgtgaatctgttacatttcttctcaataccttcttttgatgttttcatgaactttcaaaaatcacttgaatatttcggaagaccgctgtatattacttagttgttcatcaaaatatttataataaatgacgagtgatcatctattatctaaaagaaaggaatgcagggacaaaaccaatgaaacttggagcccgtattttaaaaaccggtattgccattgtactcgcgctttacctggcaacatggcttgggttgccaacgcccgtcttcgcgggaattgcagctgtatttgctatccagccatctatttatcgatcttttttaacgattattgatcaagtgcaagccaatattatcggagcagcacttgccattacgttcggtttgctttttggcactggaccagtcattatcggtttaaccgccgtcatggtcatcgccattaatttaaagctgaagattgaacacacgattccaattgcacttgtaaccgtcattgcgattttagaaagtgcaggggatcatttcctttcctttgccttaattcgaacagctactgtggtgttaggagttctttcttcatttttagtgaatttaatcttcctgccgccaaagtatgaaacaaagcttgttcatcacattatggaaaatacggaggagattttaaaatggatccgtctgagctccagacagtctactgatcattccactttaaaggatgacatcgatcaaataaaagaacgcatgatcaaattagatcacatttacttgttatacaaagaggaacgaagctatttaaagaaaacaacctatgtaaaatcaagaaagctcgttttgtttagacaggccattatggcatcgaatcgcgctctttacttgctgaaaaagcttcataaattagaaaatgaaattcatttgatgccagagcatttcagagaaagcttaacagatgaaattgattacttactgtattggcatgagcgcaccttgatgaaattcgtcggtaaaatgaaaccgcaggacgatgaatttcaaaatgaatgctctcttcgtcttgaaacgttaacgaaatcatttatccagcatcagcaaaaccaagaaaatgacttgctcgattacaatatgctaaatgttatgtccagcatcatcgaataccgtgatgaactagagcatttagatacattgattacaagcttccagacgtatcacccaaaagacagtgaaattgagacagaagaaaaagaagcatagacagaaaagaccgattccaagaatcggtcttattttattttcttcattttaggatccagtgtgtctcgtaatccatctcccatcaggttaaaacctaaaactgtcagcatgatcgcgacacctgggaaaattaatgtccaaggggcttgaacgagataaggtctcgcatcggcaagcattttcccccactctgggcttggtgcctgtgcacctaatcctaaaaaacctaaagctgctgcctcaataatcgctgttccgatcgcaagcgtcgcctgtacgatgaccggcaccatactatttggcagaatgtgacgcagcacgatgcggcggtgtgacatcccaaccgcctttgctgctagcacgtattcttcttgtttaatactcagcacttttgaacgaacgagccgtccaaaggttgggacattaataatcgcaatggcaataagggcattttgtaaggaggggcctaagatggagacgatcgcaatcgccagtagaatactaggaaaagcgagtaaaatatcaaacactctcgagatcacagcatctagcactctaccgccatagcctgcaatcaatccaagcagtgtgcctaaaatgacagacccgagaaccgagaagaaaccaacccataaggaaattcgcgcgccatgcacaactcttgagaatatatctctgccgaaatcatctgtaccaaaccagtgcgcagctgatggtgcactaaatcgctcaccgagagattgttcattgattccaaaaggagcaatgagcggtgcgaatattgctaagatcagaaataaaaagacaatcacactgccaatgaccgccagcttgtgctgaaagaacagcttcatcgattcaagaatcaatgattgagagcgttcttcttttggttgaggtggttcaagctctttttgtgcttccatgtgatcactctccctccctaatatttaatccttggatcaatgaccgcatacaagatatccacaatgaagttgatcaggacaaatatgagcgcaacaacgagaatgccagtttgaatgactgggtaatcacgatagctgatggcgtcatatatataccgcccaatgcccggccatgcaaaaatggtctctgttaaaatggctccgcctagcaagaggcctgtctgaagaccaataatcgtcaagatcggaataagcgcatttttcaacccatgctgataaatgatgaaaaatgaacgtactccttttgcttttgctgttcgaataaaatctgaatgaagcacttccagcatacttgcccttgttatcctcgcaataatcgcagcaggaattgtggcaagtgctgtacttggtaagatcaaatgcttgatgctgtcagtgaattgatcaaaccggccttgcaaaagcgtgtccagtgtatgaatataggtgattgactccactggatttctgacgttttcacggcccgttgtcggtaaaatccctaattcaattgaaaacagccactgccccattaagcctaaccagaaaatcggcatggacactccaatgagtgcaataaacatcgcgacataatcaaagaaagaatgcttaaaccaagcactgatgattccggcatttacccccacaacgatcgccagcaccatggcaaaaaaggttaattctaacgtcgcaaataagtatggtttcatttcctgggcaatagccgctcctgttcgtatcgaagtccctaaatctccttttaaaaggcccagcatgtaatgtccgtattgaacataccaaggctgatttaaaccgagctggatggttaactgttctactgcttctttcgttgcccgctgtcctaagataacctgtgctgggttccctggaataaaccgtataattgaaaacacgaccaatgtcattccgatcaatactgggatgagcattcctgcccgcttcatacaataagcaaacaaacagctttcaccgccttttctttgtttgaataagggagatacaagatctcccttatttgcttattcgaaatacacgtcagtcaaagcttctgaaccagttggatgcggctggtagccttttaaatcactagatgctgcaagcattgggatcgaatgcaccaatggaatccaaggtgcttcatcatgaatgatttcctgcgctttttgatatagctcatttcgtttcttttgatctgtctctgtttgcgcttcaatgaggatgtcgtgcattttatcgttttcgaagaaagtatagttgttgccgccaatgctgtctttgtccaaaagtgtgtagatgaaattatcaggatcgccattgtcccctgtccagcctaacaagaacacatccgcttctcctttacttgccttatctaaataggtcgcccagtcatatgtcacaatttctgctttgacgccgaccttttcaaaatttgactgaatgacttctgctaccttcattccatctggcatatatggacgtggtacaggcattgcccaaagcttgatgcgaaagccgtcagggaagcccgcttcttttaatagttctttcgctttttctggatcatatggatatggctcaatgtcgtcattgtagccttctaaagcaggcggcaatggattttttgctggctcagccagtccgctataaaatgactcaataatcgattctttatcgaccgcataattgagtgcctgacgaaccagcttgttatcaagcggctttcttgtgacagtcagtccgatatagcctacgttcattgatggtctttcaatgagctggagtgctttatccgttttaatgccatctaaatctgacggattcacaccatccatcaaatcgatttcgcctgttttcaaggcatttaagcgagccgagttttctgggatcgagcggaagatgatttgattcagttttggtttatctttctgccagtaatcttcgttcttttctaatacgatacggtcgttttgtttccactctttaaacttaaatggtcctgttcctactggattctcgcgaaaggagtcgccgcttttttcaacagccgcaggacttgcgatgccaaacggtgacatggcaatgtttttaagaaatgtcgcctgcggtcgctttagctgaaattctacttcatgctcacctttgacgatgatgtctttaatgacatgtcctttatcttttttatagccgccaaacatgccatagtaaggaaatttttctgcatcaccattcatccagcggtcaaagttgaatttcactgcttctgcgttaaagtctgtgccatcgtgaaatttcacaccttctcttaagtagaatgtgtatgattttccgtcctttgcaacatcccagtctgttgcgagacctgggtggatggtcgtgtctttctcaccgtaattcaggagcttttcaaacatattctctgtgaccttgaaggtttcgccttctgttgttgtgattggatcaagtgaagtggagtctcctcctctgccaaatacgagagtgtcttttgttgccttctcttctgatgacggagcggacgagcatccccccaaaaatagtgcaagcacgagcacaaaaatgaaactactgaacaaccaagtcttcttcattgtgttcctccttttggtataagtaacacgccgccgcatgccccggctcctcctcatacaaagcaggtgctgctttcaagcatttctcccacctttttggacaccttttgtagaaaggacaaccgccgcttggcgtcattgcagactcttctgccgacacatcttgcgtctctagcacgtgatccatatgtggaatggatttcagaagcagcgatgtataaggatgaagcgggctgtgaaatacgtcttcggcaggccccatctcgacaatgcgtccagcatacatgacggcgattcggtcgctcatatacctgacaacgccaagatcgtgagaaataaatagaaacgtcagagaaagcgtcttttgcaattcaagcatcaaatttaaaatttgcgcttgaacggatacatctaaagctgaaaccggttcatcggcaatgacaagacttggatgggtaatgagtgctctagcgatcccaatacgctgcctttgtccgccgctaaattggtgcgcataacgctccccgtaggagggatcaaaaccgacaatatgcagcatctctttgacccgcttccgtctttctgctttcgtcccatgtcgatgaacaatgagcggttcctctaaaatatctttgattttcatacgtggatttaatgaagcatatggatcttgaaaaatcatttgaatgtcttttcttaaagaacgcatctctctttctttcaaaagagtgacctcttgccctttcagttgaatagagcctgacgtcggttcagttaatctcattaagcttttgccaagtgttgatttcccgcagcctgattcaccgacaatgccaagcgtttccccctccttcacgtgaaaggacacttgatttaaagccaaagtcgattgtttatgtttagaaaaaaaagcggctgtgtcataccgttttgtcagccgattcacttgcaagagtgggtgactcagtgtcttctcctccttccattagaaagcacgccacgcggtgatcctgttcaatggattgtaaaacggggtcttcttcaagacattgcgccatttgataggggcagcgcgcggcaaattgacagccggatcgaatggtccctggcttcggtacatgacctgcaatagagatgagcttttcttttttctctttgaacgatggaactgaggcgaaaagaccttttgtgtagggatgcagaggtttttgaaaaatacggtcaacggttccttcttctacgattcgaccggcatacataatcatgactcgctggcatatttgccgtacaacgcctagatcatgggtaataaataagatcgcggtgtccatctcttcgttcagctttttgagcaggcgaaggatttgcgcttggatggtcacatcaagtgcagttgttggttcatctgcgatcatgagctttgggtgacaaagcatcgccatcgcaatcatcacacgctgacgcatgccgcctgataattcatgcgggtattttttaagcaacgattcggcttgcttcaatccgacggtctgaagcagatcaaccgccttcgcttttgcttctttttgaccgattgcttgatgtgtgaaaagggcttctgtcatttgtttgccgatggtcattaatgggttcagagaggtcattggttcctggaatatcatcgaaatgtcatttcctcttatttctcgccactgtttttctgaaagcgacagcaggttttgcccttcgaattggatctctcccgttgtctctgtttgctggttcagccccattaatgacatagatgtgatacttttcccgcagccagattcgccaacaattcctaaggtttctcctttttgaatcgagaacgatatgtgatggacgatgggtactttttgctttttttgctgaaatgcaatggacagctgtttgacatctagcagcacgtcttgttctttcacatattcaccaccccgtcatactttttaaaattgtattgagacaagctgggaaatatgtcatgtttttgacaagcataaaaaagcctatccgctagaatcggataggcttctactaatttaatgtttgaatggtaaaaagatggcgatagtggctgtctttgttcattaattcttcgtgtgttcctttttccacaatctcaccttgttccatgacgacaatgaggtcagcatgtgtaattgttgataagcggtgcgcgacaataaaggttgtgcggtcctttgctagcttttgcatcgcttcttgaatgtaatgttcactttctaaatctagtgcagacgttgcttcatctaaaatcaacagcggtggattttttagaaagacccttgcaatggaaatccgttgtttttgaccccctgacagcttcacgccccgttctcctaccttcgtgtcatatccttcaggaagagacatgataaaatcatgggcatttgctgcttttgcagccgaaacgattttttcaaaagaagcttctggatctccaacggcaatgttttctttaatcgtgtcactgaataagaatgtatcctgcagcaccattccgacttgatttcgaaggcttcttgctttgtactcttttatatcaatgccgtcaatttccagtgatccgtttgtcacatcataaaatcttggaattaagctgacgagagtggacttccccccaccgctcattcctacaagcgcaaccgtttgtcctttttctactttcaaggagatgttgctgagaatctcttcctgcgtgtgttcataacgaaatgacacatttttaaattcgacctctccttttaaatgatcggcttcttttgcattcggtcgatctgttacctcgtatggctcatcaataaattcaaagatacgatccattgacgctaccgactgagttaaagtcgtggatgagtttatgaggcggcgaatcgggttgtacatccggtcaatataaccgacaaaggcaatcatggtcccgatcgaaagtgatccattaatgacggtgtagccagcaaatgcaatgattaatagcggtgcaatatcagtaatggtattgacgacggcaaatgttttggcgttccaattcgtatgattgatcgctttgtttaagaaatttttattttcatcatgaaaattctcttgttcatattcttcaatggcaaagctccgaataaccggcattccttgtacccgctcatgcaaatgcccttgcacttcagccagcgcctgtgaccgctcttttgtcagcttacgcagcctgccgtaaaaaaacttcactgcaaacgcatataacggaaaaataatgacagaaacgatggtgagcttgatgtccagtgtacacataatggcgatcacgatgagcacggtcatcaaatcaagccaaatattcataagacctgtgatgacaaactcttttgtctgctccacatcgttgatgactctagatatgatttctcctgttctcgtgttggcataataacgaaggctgagcttttgaatatgcgaaaacagcttttctcgaatatcaaataatactttactgcctgtccactgcgcatagtattgtctatagtattcaacaggcggtcgcatcactaaaaataagacgagcatgattcccataatcatcagtagagatgatgtcttttcttcagccgaccccgagccttgaatgacatcatcaatgacatactttaaaagcagaggcaatgttaagggaatcgagaacttgatcatcccgatgaccattgtcaatgcaatctgttttttatacggtgttacaaaagccatgtaacgtttaatgacccccatgtaaatctccttcccaatctatcagtgcctcttatccgtacgcaatcaaaaacctgttagcctaaaaagctaaacaggtttttgctgctcttgcttattttgtataatgtaaaaaacgttcataccacatatccacaaattcaggagcaaacggacctttccgctggtgaatccaatgcaataatgtattcagatgctctcttaagatactatcgatttcctttggataattcatctgcctcttatgatctgcatattcatcctcatccaaaatattgtacgtcatgtccggaaagactttgacatctaagtcgtaatcaatatacttaattgcttcttcatctgttgcaaaaggagagctgatgttgcagtaataatataccccatcatctctaagcatcccaatcacattaaaccattgttttgcatggaaatagcaaatagccggttctctcgtcatccaagtacggccgtcggattcagtcaccattgtccggtcgtttgcaccaatgatacacaattccgttgctttcagaatggtggtttcattccaaatcctgtggatcaagccattgtgtttatagctttgaatttggatggtttctccttccttgggatagcccatattttctcccctactttctataacaaaaaaacctaacagtccaaagacctaatttcctaactaaacatgtctctattatattataccgttacatcattaaaaaatgaaatgaaaaagccattcaacccaattgaacggcacactgtcttacatcacggttgaactcttttccatctgcttatatgaattgatgacctcttctgtctgttttgtaaacaaggtttgaactctttgcagttccacacgtttctgtttgatttgatcatgaagcctggtccactcttcttttttttcatcttgcagcaattgtttttctgtttctaagcatagatcgagttctccctgtacattgagcagttgatccatgagctgcatttgttcttttacaagctgatcgaaatcagacatctaactcctcccttttattttcatccactttttgtctgtataccatttcttgaaagatcgccgaaatcctttgactgtttatgtagaggttttacaggttttgtcggatggtggggagaggcaaaaagaaaagcacttcattcgtagatgaagtgctttctctgtttcagtgattagctgttttgttgtttgttttgctcagctttttggttatatttttttacgtgctgtgcgtcagtctcgctagcaaattcagtgccatattgaccaccttgtgcagcagcttggttttgtttcttcacttgttgtgcgtttgttttgttttgttgtttgtccatcattatcacctccacgcacattaatttgtgcagaaggtgcaaatcctattcatgatttttttaaacaagcaaagaacgtccgccatccacaataatcgtctgtcctctaatcatatctgccttgcctgatacaaggaattccacactgtcgaccatgtctttaatttccaccattcggccagctggtgtatttttcttggcgtcttctaaaagctcttctcggttcgggaagtgcttaagtgcatctgtatcgatcgcgccgccagatacggcattcacgacaatattcttttgtgacagctccacagatagataacgcgtcaatgcttctaatgctgcttttgagacgccaacaactgtgtaattttcaagatagcgaatagagcctagtgagctaatgctgacgatatgaccgccaccgtttttctccattagtttcgccgcttcttgtccgcaaaatagtaacgcttttgcattgatattcatcgtccagtcccaatgattttcttcaaggtccatgattggacgctgaacaccagatgccgcattgttcacaaatatatctaaacggccaaaggtttcgtcgatttgctgaaacatatctttaattttctctggctgacctacgttggctttgacaaccaatgttttaacacccatcgcttcaatttcttccgctgtttcaagtgcggcttttttgcttctcgcatagttaatgacaatgtcatatcctttttcagctaggcgaagggcaacttctttccctacacctctgctgctacctgtaattaatgcacatttacgttgactcattattgttcatctcctgatttgaatagttttcgtccattcgcttcacactaatagaaagttcctattaggaggttacattcatgtatgtcggacgcgatttaagccagcttggcatgatgtccaaggatcaatggaaagatactgagcttgcttactttcatcatgctttccaacaaattttaccttatttaaacgaagaagggcaatctaagtatcgagaaatcatttctgaaattgaagaccgcgggggtctgcaccgaaatgaagctgattatacccacgggacaacggttaaatacgactaggctcttcaagtgccagcttccaaattttttggtgtgagactggcaaagcatatgcctcaaattcttctgttgtgactttcttcagcatcgtgtcatcagatatagaggtaactcgtccaaagaaaacagaaatattccagatgaggtgggtaaatacatgctgaatggtgccttctaagtcaccaagctctgcttgtacacctgcctcctcttttaagaaatcaatcagctgctctttttccgtttttcttcccttcattgtttccatgtttgggaactcccataaattcgcaagcagacctgtacttggccgcttatgaatatagaggttgcctgcgtcatcaaataacaccgctgctgccattgattttgcagtcggttttttctttttgcttttcactgggagctcatgctgaacaccttcttcgagtgccgagcaatgcatgttcacaggacaaatgaggcatgcaggggatgttggggtgcaaatgagcgcaccaagctccatcagcccttgattgaattctgatggcttttcccgggaaatgagctgatcgaccgcaaactcgaaaatatttctcgtttttggttttgcaatatcatcccatatggacaaaatacgggaaatgaccctcatcacgttgccgtctaccgcagggtacggcttgttataggcgatactcagtactgcgccgctcgtatacggacctacacctttgagctttgaaaattgctctttcgtatcagggacaatgccaccgtaggattcatatacttctttcacagctgcctgtaaattacgcactcttgagtagtagccaagaccttcccatgctttcatgaccttttcttcatcagctaaagcgagatctttcaccgtcgggaattgctccataaaccggttgaagtacggaatgaccgtatctactctcgtttgctgaagcatcacttctgatacccagactctgtatggatcttgattttcacgccacggaagtgttcgttgttctttttcataccaatcaattaaatcatgctgaaatcccgcaatattgttgcggtccagcttttcttgaatgtctttcatatctatactccttctcacttgaaccgagggctaacgttctgaaaagaaccttatttgttgtatactgtttgtagatacgttaacatgttacattaaatcaagacaaagcaaaagtgcttttgcacatagtcttgaaagaaggcgtatactttgtatgattgttcctaagcatgacaactaggaggtaatcaattggatactggtactcatgtagtaatgggcatttctcttgggggacttgcacttttagatccagccgtcagcgcagatccacacatggcacatgccgtgatgatcgcgaccatcgccggctcccaagcaccagacattgatactgtgctaaaactaaaaaataatgcggtttatataagaaatcaccgaggatttacacattccattccagctgtactgttttggtcattgctaattccggctgtgattttcccatttgtgccaggggcgaatatacttcacctttggctatggaccctattagccgttgtgcttcatgtgtttgtcgatattttcaatgcatacggtacgcaggccattcgcccattttcgaagaaatgggtagcacttgggatcattaacacgtttgatccgtttatcttttttacacaccttgtcgccattgtcgtatgggcgattggcgggcatcccggctatacgttcattacgctgtatgcggtgattttttgttactatatcgtcagggtcatcatgcagcttcagatcaaacgtcagctgcgtgcacgattcgatgagattgaagacattattatttcgcctacaatgaagttcagacaatggcgcattgctgtgaaatgtaaatcctctttccatgttggacgcagtatgaatggtgagattatcattttagacacctttaaccgtgtgccggtccctgatactgagattatgaaaattgccaaacaggatgaaaacatttcagcctttctctccttctcccctgtctaccggtgggaagtagataaatacaaggatcattatgaggtacggttcattgatttgcgctaccgcagcaaaggtcattatcctttcgtcgcgatctgccatatcgacttggatcatcaaatcaaaaattcctataccggctggattttcagtgaagaaaaactgcaaaaaaaattaagactcggctctgtgtgagcgagtctttttttgttgtgtagggcttggatttagggggggaagtacattattgattattcattttgtgtagattttgaactggataggtagttgaatttgtataaaacaaagacactgtgatctatgcactcatgtagagtgcgacctgtagaagttgatattaaagcaaaagttgaaggatttcaatccacgcactcatgtagagtgcgaccataaaacaagttgctatttgccatattgtctaatttcaatccacgcactcatgtagagtgcgacaagatcgctcaaaaggtagcagaattgaaatcgggaatttcaatccacgcactcatgtagagtgcgacaaatgccctatccaatttaatggttagggcatcaatttcaatccacgcactcatgtagagtgcgactgcgatttccgccctaattataacattttttagggaatgatcgtcaaaaccctcaattttctatatagaattttgttttcacccctaaacaatatacattttttctcatctttgtcgaataaaacggtgcgaatgttccagggattttatgttcacctcacattcgcaccgaatttttctagtctgaaatctatttgaatcttgataatcatatttattatttcagcaacaactttgaactgaataaatacatgactactgagaggcagagttatgtatttcgcaattattaatctacacactcatgtaaagtgcgacgccattgaaataccagaacatagagaatcaatatttcaatccacgcacgcatgtaaagtgcgaccagtatctagaacaattggctattatgtttgtaatttcaatccacgcactcatgtagagtgcgactgtacgtcaaataactatcgactaaacgtgtggatttcaatccacgcactcatgtagagtgcgactttaaaacagacagggacgctttacagcaaataatttcaatccacgcactcatatagagtgcgactgaaggtcccaatgattattcctttgaaaaaatatttcaatccacgcactcatatagagtgcgactgcatcttcctgacttaaatgctgatccttttcaaatttcaatccacgcactcatatagagtgcgactgcgatttctgccctaattataacattttttagggaataatcgtcaaaaccctcaagtttctatatagaattttattttcccctctaaataatatacattttttctcatttttgtcgaatgaaactgtgcgaatgttccagagattttatgttcacctcacattcgcaccaagtttcatgaaatgacgtcgtccattttaagtcttccataacctgcatttgttttagcgccgattccttcgtgttctaaagcgcctagtaagatggttttggcgagttcgagccattccacttcttctggtagattcttttttgttctcaatagaagttgaaagcggccgttgaccaccgttaagaaaagaatcggtgttggtgagtcatcgtctcgaggcgctggaacacttccccctttgttcatcttatctagcttgacgctgttatagtctgaatgatgtggtgtcatcacatctactttgaatgcttcctttactgtctcaggcattatgagcgcatcatgaaattcgatgatgccagcacgttcgtttgttccaaacaatgtgttgtaatcactaccacctagttttagttctggaaagttttcacctaatacagaatgggcataatgagaggctacaccttttaaagctgttcctggtaaataaggaacgccgtatatcgggtgtaataacaaacccgtttcaagtacaccctctcctccatgtccaatgactaacggtgatatggatttgactaggcatgtggggttcgtgtcagtataatatcgctccaaaaacttttcatacaacaagcgatttttcccccattgttttcgatgtagattaatcacattttcataaaatgactgcttctttgagctgtcctttatgacgttcgacaatgtaaaaccatcaatctcccatttgcttttgtttaaggttaatgacagattcattgaatgtcctccacattttccgccccttgttccacctttaaaattgattccgcatatctttttaaccaaacagatgcacttaaagcttgtcttgatttgattaagtaatctcgattggaagctgaccaactttcttgtaaatctaaagtttcttttatatcttgaacgaattgttgataagcatttcctttttttgattttgcttcaaaaaatgtaatggtgagccttaatccatttgttaagatcattgaggcgaatctgtgacagagttgtccatattgatttgagaaattctcctcattcgttttggcattcatcacatgttgatacgctttctcagcataatgatgttgaatgagtttcatgatctctcccctcctgtcatacgccaggatactcttcctttacctacgtttgtgtttccacctaattgaagatacatctgtttttctagttgatttaacagttggtgtctaacagataaatcattgcttccatcaacacgatcacaccacatgagcccataaaatatggcttctgccggtacatactcttcataccagagagctcctttactaactgtttgggtttcatgatcaattctaatacgaggtgtcacttcagaattcatggtgacaatgtattgaaaaacgtcatcacttacaatcacaaatcgttctatccaaagagtttgtgatggtttatcgtcgaataaaagtttggccatctgttcagcaaaatcggttagttgttgagattttttcgcttccccttggaattcacctaggtataattcgtcattctctactaatttagaattcaaggtgactagcgtgcttgattcttctatgggatcagggatatccagcgatacgcctaatgcttttgcatcgcgagctaatctttttaatatgagtggacttgccacatatccaaatgtaccgtatctactcgccaccgggaatgaaaataaccggccatctgtcatgacgactgctcctgcgcttccatcttgatctccttgtgtaccaaatactttttgtacgaatgtgtcttgtcctttcgcgcgataatgctcacgctgcacgcctttgatactgcttccaggtataatcggccattctgttactttttctcgttgaataggcatatcaatcacgccaattccttcacccgctccaatatggaggggggataaacaatgtatccaaaaccaacggcttgcttccatcatctcactcctcttattcattcggtttccatgttccccaaagtgctaacccgcagccatcttcacgatcaaacgcttctttgcgccggttacgatcggatactgattgaagccacattttttcggccagttctgctggatctccttcttctactgtaaagaagtaaacgctacccgcagggactaagcggcggattgctttttcacgccctttgtctttatttgctaagctccatccagagataggctgccaatgtggaacagatgcccaaaccaatttcagtcgtacatttgtatcaaatagtggttttgacatgagctgttcatccagccagccgggctgccatcctttactgaaataagcaggtgtcgccaatatcatgcgaacatacggcttgttcttgagcgattctttaatcatatctggacatgtccaatcttgttggtatacatgtggccggtcttctatatgagccagccgcctttcaccacctatcgggtgaagacttgagaacggctttaatgcttctgactcttcagtagataactctattcccgcctccagtttaaagtcatctgggaatacgagtgattctgttgaaaatagatgctgatcttttgcctttttactgccagtttccacctcaatttgtgtccgttcctgacgctgtaaggctggaataaatgccggtggtgtttcctttttgaaagaatgattttccttctgcatgtgttggtattcagtcaaggcttccttcacatgactctcatccactgcgtctgtcagccagttcaccatccactttagtgatacaaaagcaggcggcgatttcatttttttacgagcaccagctccaattggtggccataatgcctcactaaaacggcctgtttttcctgtaccaaaaaagccctgtccttccgacatcattgactttggtctcacttgatacatgccatactcatcatcaaataactcaaggtcatgaggcattggcacatataaatgatcatgccagcgatataaaggacctcgcacaagagattttgaataataagaaagtggcgtcgtgtgttttattgattgtcgtttcttcgctagagctgtacgaagtgttcctgcgaccacacttggcggaacatcgtttaatgaacgcgcccttatacccggtacactttgaaatgggcgtgcatcacgaataagcagcggatcaagcggttgaatgtgaaaccatctttcaggcatgtccacttacctcctctagttgaagagcaatgatcatacattcagcgattgtatgtaattcttctaatgtattcttcttcggtatatacttcgcaatcaattgatcgatccactctttcgtttcttgctctgtttttgcttccgttttctttttgaatgcaagacgtcttatctctagtggaatgagttcatctaaaattgctggctgttttttaaatgaagactgttcgtatgtttgatacaactctcgtaagccatatgcaaagccagatgtgaaataagactgctttaaccacgtcgtcatctcttggatagacgctactggatcgagttgaaatgagactgagatattcattgcgtctcctccgccacgtttttggaaatgaatcgctaatgaatttcgctcttgttttgcatattgttcagcctgacgtgccatgctccttacttcttcgagaggctcaagcatatgaacgatggcgatgccaattgaaatcgaaggaggtgtctcactatgttgatgagcattcatcgttgaaacaaattcactttgtaatctcccagctgcttctaagcatttgtgaaccggtacataagccatgacatcatctccaccaccataaatcaatgtaccttcacattcggaaataattccacttgcctttgaagcaaaagttgagagcgttttagaaaatgcaatatgactttctacatgttgtatatttcgcagttggctgcccattttatctccatccgccatgagaaaggcatagtaaggtgaaggtgctggtggtttgaccggccggccatgatgcttgctgtattcacctttgaaatatttttcgagcagctgtgtgatatcatttttcgcttctgttcgtgtggtcccgacaagtccacgttgttcaagataatcttctattcttctttcataaaaaagcgatgcctcactcaaatcaagaggagctactgttagattcatattcttaagatatgtttctacatctttcacatattgtgtggcagctttcttctgttcattttgtttcaacatgttttgatagggagcaaacgctttatcgcagactgatggaaaggtcatactcgggtgcttatgtatagataatcgtttgatcactgaaatcgcatctaatgattcatgttcaccaattccccatttagcaagttgcgccacttgctgtggtgttttttgcttttggaaaactgattcccggccaccatcaagtgatgattttggttcaccgaataacgcccctggctcattttgtttaaaatctcttaaagtcttccttgcagccattaaaccttcgacttcttgaagagccatatgatatggacttgcggacgcatttgccgcttcctcttgagtttgcatctcagtccacacagcataaaattctattaaatcatctacttgtcgattccatgtgcctatttgaatataaggatcaactatttctctaacaaagtctgcgtattccttccatttgtcatagattgcttttttcacttgtcttgcaatggaggaaggctgttcgtgtgaaattcctcccaatattttgtttggtgcgttgtttgtttttgcagaggattcgttgaacacagggaaaataagcgttccacccagttcttgaaatttcttcgcacctgctttacttaattcagatagaagaaaagagccaaaccataaatcacgcgtccgccttgcttgcgcaataaattcttgaacaggccctatcgaaaatagcattaatgtttgtttttgtaattcttctgacaaaatgtttgcacctccttgctatgtaaaaaagcttgaatcgccgatgagtgcgtacggccactctcgtcttgtaatgggttgtttgagtaggtggctgttgggtagatactttgttcatctgtcacatcgggcaaaggctttctgtcccctaaaagcgataaagcttcgatctttggttgctgcaacaccatcaccatgcccactgattccttttgattaatagctaacggttttaagatgagtggtgaagccaaacgatcctttcctttaggtaggagcgttgtaggatttgggtctttccccttatctttaggagcaaatcgaaactgaataggcaaaccaaattgagctctaggaaatgcttgatattcaaatggtttctcttttggatatggggtttcatgacctgatttagccttacctgttaacagacgaatagtatctgcttccggccaacaacttctccccatttttttattcgggtttgatcttcttcgaaatgtttcatatgtctgaatgacggatcgccagcttgagataattgatgatggaaatgcctgtactttgaattcacgactaagcgtcggccattctcgacttgatgctggcaattggatgtcatattctaaaagtttttgctcaaaccatttttccaattggctttttgtcctcttgttgtatggtgaaaattgcttgcaatataaactgccacacccacgtctcgttcttgacccaagtccaccgaagttgatccaagcccataatgctgcttcaacttcttttttgattaactcaaattgggttgtttttttagataaccggatatttaaagaaaattgcgccttcatgaggtatggtgtttgatctttcatatttgaaagaacataccgtggaaaaggatgatttttcttatttaaaaatgattttgaatttcttttcaattcgtctttctcataatgcgttaccacttgaatttgactcgcttgttctgtatgaccaaatatctctgcttctcttttagataattcattcgcatttttgcaggcagctcctcgagttgcacgccaccagaaacgaagatgtccacgaattgcactttctcgaatcggtctgtcttgatcaattgagtttgattggggccctcccccaaacattggcgtaaccaaatgaatagtaagcggctctttaaaaagtctttggtcttcatggattttcgtatcaatcgcatgtttcacatcatgccaattggttttgggttttctagattcccttgtcatgtcgctctcctttcttcactttgttatctgtttctgaaacagcttggcatatgcatagtgagggaaaaacatgggattgttaatgagcatcagcaattgatttaattggaagttcagcgttaacagatcgtatccatcaatacgtaaatcgctgagtttgttttcatctaaaaatttttcttcttcctgatatcgtttttcttgtttgaaacaatttaattcgtttgaccaccatcttagatgttcatgttcattaggtactttcaattgaaattcattgctttttttcatgagcatgaaatcaaaggacgccgctaatttagctgctttacttgaaattgtttggtctccttctcttttaaagttacttgctaaaatgagcaaaggacgcgtcctcttttgtgtgttactttcacttgtaaagtaacctgtagccattctagcaattcctgttgtttttggtgttaactgttttattttttcagaccattcttctaaacctttttctttcaaattagagcttttacattcaatagcaaccgcaaccgcctcaatcggtataaacttcaacgaattgtgttggaacacatacggcgtatactgctcatcaaatacggcaatatcgacttcgttagaatgatttccatctgagtcaataatgatgacaccttgtgctattgaatattttttaggaatgattttccgaaaaaactccatccacatcacttctctagaatcccctgtcagccctccatggttagaagcaaagtccacttcttctgatatcatgctgtttaatctttgataattctctaagatcagctgctccactttaccggttcgctccgtttcacccaaaccaattcctccttcatcattcattacgaatggataaaatttgaatctaaatgactacttttcatttcgacttattttgagatttttttaggtttatttaggaaaaagaagaaaaaaaacatgactgcaatgagtcatgtttttactatacatatgaacagtctattttgatggcttttgtatctgaaagagggtgttgtaagaagatgatctctgagaatgtcatacccgtttaagacacaatcatttaaaatcacgcactcgtgtagagtgcgaactgtaaccgaattgtcacgagaaataggaaatcacttatttcaatcaacgcctcatgtagagtgcgacgtatgaatatcgactttggaaacagcatgtacatatttcaatccacgcactcatgtagagtgcgacattttcaagctcgaacagaaaacatcatttcttatttcaatccacgcactcatgtagagtgcgactgcgatttccaccctaattataacattttttagggaatcatagtcaaaaccctcaattttctatatagaattttgttttcacctctaaataatatacattttttctcgtttttgtcgaataaaaaggtgcgaatgcaccagggattttatgttcacctcacattcgcaccgaatctttcttaatcctatttaaataaaaactattgctcttgaaaacatacttatttcactgtttcatcaacaggtttgaattcatttaaaaacatgtctactgagccagagtcatgtttttcacccctaaatcaagctcaactgtcaatatttctttcaagctacctaatccatacactcatgtaaagtgcgacacatagaagcacctgagcatggtcacacaatcattatttaaattcacgcactcatatagagtgcgacggaacaaaggcgacgagtgaccgccgacgttcgggatttcaatccacgcactcatgtagagtgcgacgggctcaaactgtcaccggctttgctgcaggtcaatttcaatccacgcactcatattgagtgcgactgcgatttctgccctaattataacattttttagggaatgatggccaaaacccttaattttctatatgtaattttgttttcacctctaaataatatacattttttctctttttgtcgaatgcaaagggtgcgaatgtcccggggattttatgttcacctcacattcgcaccgaatttttcttaatcctatttaattaaatactattgatctaaagatacttattcattatttcatcaacaggtctgaattcgtttaaagaaacatgactactgagccagagtcatgtttttcacccctaaatcaagcacaattgtcaatatatttttcaagccacctaatgacgagaatttcagtcctcacactcatgtagagtgcgacgacatcgtttatcatctgaaacgtcttgcacgccgatttcaatccacgcactcatattgagtgcgacacattggttgagtacataattaaaaaattacaaatatttcaatccacacactcatgtagagtgcgacgctgtggcgccttattacacaccagtaaaaaaagaatttcaatccacgcaatcatgtagagtgcgactgcgatttctgccctaattataacattttttagggaatgatagccaaaaccctcaatttctatatggaattttgttttcacctctaaataatatacattttttctcatttttgtcgaataaaaaggtgcgaatgcctcaggaattttatgttcacctcacattcgcaccgaatctctcttaatcctatttaattaaaaactattactgatgataatcatacttatttcgctgcttcatcaacatctttgaattcattaataaaatggctgagacagagttatgtttttcacacctatttcaagcgcaatgtcaataaatctttcaagctacctactgacaagaattttattcctcacattcatatagagtgcgacaaatataagacctgtaattaatacggctactgtatttcaatccacacactcatgtagagtgcgacgcgtctttctttccttctggtgcatcctcagcgttatttcaatccacgcactcatatagagtgcgacgaggatacgcctatgcaggatcgggcaatattatatttcaatccacgtactcatatagagtgcgaccttttagaaagtggattatgagtggagctaagttatttcaatccacgcactcatatagagtgcgaccttttagaaagtggattatgagtggagctaagttatttcaatccacgcactcatgtagagtgcgactgtaagggacgggaggagaaaaacttgaataaaatttcaatccacgcactcatgtagagtgcgacatatttacaagctgcaggagaaactatttgtaaaatttcaatccacgcactcatgtagagtgcgaccgtctttcccttatcaatggcgtatctggatacgatttcaatccacgcactcatgtagagtgcgactgcgatttctgccctaattgtaacattttttaggaaatgataggcaaaatccacaactttcaataaagaattttgttttcccctttataaaataaacattttttctcaattttgtcgaataaaaaggtgcgaatgtccctgggattttatgttcacctcatattcgcaccatcagttcctcttacaacttcgtcatatattccacaataaactcccaaaagccaggtccctcctgataaatcagcctgtctactttttcgatgagtttgatatagagttcttgttcgaggtcttctctttcttgatatgccgtgttttgtagtttctttttgatcatgggtgtgaaggtttcaatgagttcttccatttctccattggtcattttttcttcgttcacggacatctccccctgtttcttcttttagtttgttgagcgcttttttgtggatgtttgagatgttttgtcttgattcacccagccgatcggctatttctttcattgtttgaccttcaacataaatatgggttaaaaccattttttgtttgtctgtgagctgctggtaggccttgtacaatgtttggtcttgcaggtgctcccccaggtcttgctggttgaagagcacagcttcatacgtatctgtttgaacagggtctttcacttcttgatgatcaggatggtcgagtatgagcggaaaacgctgctgcttttttttgactcgtttgtcaaagtcgactgaaaagatgcggatcattgtggagatatacttgatgatgcggattttttgataaaactgcttgaactcggaatctagttttttcgcattttcttcgtttggctcttccatgacttgcttaagcagctgctggtttttagggttacttaaaaattgctgaatgagcgggtgatcaacgatttcattccattttgctttcaataacagccgataatccatgtgcatcctcccctttgttctctctacttgcattaagtggacaaaagttaaaaaaagtaaactttgtaaaacgggtctaatggttcattttctccccctttgatttcctatttcttctttcataccacttataaagatgacgagcatccgctgggaggtgagacaaatggagacctttttttcggaggaatggctgaagcagctcggtcaggctggctttcctgccattttgacggtttatttgctgacacgttttgaacgaaagtttgatgaattaagcaagctcatccaacgattggtcgctgttcaaaaaaatgatgaatcagattgacatcttcttgattcgtttcaccttatgaaaacgagggcgaaatgaaaggccttttgtcacctcacacaatacgatgttgaaaggggattttatcatgagtgaaaagcaaaatggtgtaccacagccgattcgaggagaaaaaggagcaacggtcaaaattccacgtaatctcgagcgagacagacaaaacccagatatgctcacgccaccagaaaccgatcatggaacggttcccaacatgaaatattctttttctgatacgcacaaccgtttagaaaaaggcggttacgcaagagaagtcacggtacgtgaactaccaatctctaaaagtcttgcctctgtgaacatgcggctaaagcctggtgcgattcgcgagctgcactggcataaggaagcggaatgggcgtacatgatttatggggaagcccgaattacatcggttgatgcagaggggcgcaattttacagaggatgtgacagagggtgatttatggtacttcccttctggcttgccgcactctattcaagcacttgaaccgggagcggaattcttgcttgtgtttgatgatgggtctttctctgaaaatagtacgttccaagtgactgattggcttgtccatacaccagaggaagttgtgctccaaaactttggaatgacaaaggagcaatttaacaagctgccagagaaagagaagtatattttccaaacaggaattcctggttcccttgagtgtgacaaggtgaaaacagagcaaggagaagtcccgaattcctttaaatatgagctgttaaagcaagagccgattacgtcaagcggcgggcaagtgtggattgcggattctaccaacttcaaagcgtctaaaacgattgcctctgctcttgtgaaagtcgatccaggcgccattcgtgagctgcactggcatccaaatacggatgaatggcaatatttcatttctggaaaggcacgaatgacggtatttgcttctgatggacatgcgagaaccttcaactatcaggcgggagacgttggctatgtgccatttgcgatggggcattatgtagaaaatacaggtgacgaaccgctttatttcttagaaatcttcaagagcgaccattatgcagatatctcactgaatcagtggcttgcggtcacaccgaaacagcttgttttggatcatttagatcaaggcgaagaattcttgaaattgcttgatactgaaaaacatcctgttatcgctgcacctaaaaaagaggattaattccaaccttcctgcaaaaaggctgtcctttttgcaggtatcttcatgtaaaggagtgttgtttacccatgcaacaatctgttcacgctttatggcaagggctgaaatggctcatggcgctatcagctgtctgttacatatttttgttgttttgtgtgctgttctttcatttgacgggtgctttttatcattcgattttatcgctgcttctgtttatgggcatctatgttgtacttgggatctcttttgaacatctggaacacgtgctcatgcggtttgttcgtaagtgtcggtccaaaaaacgatccatcgttttctatgccgttttatttcaccttttgtttatttggggtgctgtctacttatcagatgaattggttgacggcattttgctgactacttctgaagaaattctctttgcgctaagtctttggttatttcattttttgtttgattatgcgacgttttcgtttgataaggaagcttcgtgaggcgctatcgtctttttgtggagagcgcttgtttgacctgctccatatgatgaagatcatgtttaatcaaaccttgaaaataacttgataacgtcagctcggtttgaccgatcagaaagggtgtagtccagcgagatgcttcgattttcttcatttcttgaagcaattctgttctaacagcaataaatcgcccgatcgtctcgcttctctcttcctttcttgctctttcggctgactgctgattcatttcatgcacatcaggtgcctgaggtaacgctttattgttccaaaattcctttaggcgatcgtgtaaaataaattcatcccatggaacgaaatgtgcgatgatctcagcaatgctccactttccatcagcgatggcgctatgccattcttcttctgttacttccgttagtgactgtacccattcaagggtgtgtccatagtgttttatcacggtatctttgttcatgttttgttatccccttcatgtttttaaaagaagttgatcagaaattggatagtttcattcttgctaaatcatttataacatattatcatatactttaattaccaaatgaaaagggggaattgtgatacgctgtcctatataaaagagcttatttttttataccaaaataaaccgaccggtctgtttataaaagaggaggggaaataatgaaatctcaaaatgtgatcattatcggcagtggtgtagcaggattggctactgctttatttttaaaaaaggctggaatggaaagtacgatttatgaaagcaggtcagatgaagaattagaaacaggagcaggttttttactctctccgaatggggtaaagattttggatggaatcgggtgtaaaaatgaagtgatagcaaatgcaacagtgataaagaagatccagcaaataaacagtgaaaatgaagtagaagcgatctttcacaattatagtgaaaaatattatgatgctcctttactgaacgtcatgagagaccaaatcatcaaatcacttttaaaagaagttcaccgtcaaggaatagaagtgaaatacaacaaaaagttaacctcaatcaaacagcagcctcattccgttcaggttctttttgaagatgaaactgagataacaggtgatattgtaataggagcagatggaactttttctaaaacaagagaggctattgcgtttaatgctaaattagactatagcggtttttggggactgcaaggagtatcgtttgtgaaggattttgtattggatgaggcaacaagttatttttacaatgacggaaactttcaattcatttttggaaaagcgcatccaacaaataaaatgaatattttgtggcaagctttctctcagtgtcctgagaagttacctacaaaacattttgagaaagccaataaagaaaccatccgacagttattatataaacaaatggaacattggaacattcctaaacacctttctgacatcatcgatcatacaaacatgttctttccaagaagtatctatgaaataaaggattttcctgtgtggtcaaaaggacgtgttgttcttgtaggtgatgcggtacatacggcgaacccttttgttggtcaaggagcatcgtatagtctagaagatgccatgctcatagcaaagatgctaagggatcatgattatcgagatgcgttctattattatgaaaaggatcgaagaaagaggacagaagaattgaatgcgctatttcagcacatgagtattcaaaacgatattgataaaaaaatgaacgaatacacgattgaatgggatgaagaaacttacgtatgagatgaaagataaaaaaacaccacttatgctgaaaagtggtgtttcttgtgttttctccgtgaatagaggatcgcaccgatcaaactgatcaatgaaatcaatgcgagaattctgatataaggcggatagtaggttagcacgatctcgtttttgcctttttctattggaaaaccgataaacgcataattggcttgttcaatatcggtttgatggccgttcaccgtgagctcccatcctttttcatatggaacaggcagaatcatataatcatcgccgcgcttgttctcataagaaatcgtaaagcggttatttttaagtttcacctgctggctgccatcatcctgtttttctttttcatatgcccgcgcaagggtgcgataaggctcatgatacagctttaattgactcagctcatacgtcccttttggaactcgtatagaaaggattttttccgcagggactcgaatcgtcacgtcattaactcctgttttgtagatagacgtattgcttttgcgtgatgtgacgtagtcatccacagataactgaaacccttcgttacggtcggtccgcttcacataaaagctcacatacacatccccggcacgagcgatgtcatctggcagtgtgatattcataccgcccatatccccgtatacatcaagcacgccatgttcgtatacagcttgttctgtatgaatactcgtatctttgattcgatctgctgcgcgctcgatttcagcgttaccttttttgtctaaaatcacgccttgcagcatcgcatgctctttatcaagtgctgaggcatcctttaaggattgttctgaataaacggtgctcgttgttcttgcaaatggcagtgaccgagtattttcatatacctcataatgttcacttttcaagattggcttaaaataagctggtggtgagtaaggcatcatgctgtttctcatataatactttccgtaggtcaggctgtataaattcgccctgtcccccattgttgcataacggctgacactttcccttcccatatcgatttgcaggtcattccagtagaaattgagcaaatgctgattcaatatacttgaatacacactcatgccttggaagccttcaaataatggggtattgtttcgcacgccattcatccaatcaatccgggcgagcggatcctttgagcggctttgaatttgctgaatgagcttcatttgttcatgtccagcatatacctcactattcagatacgtatctgatacgctcttaatattgcttctttcagataagtatccctgctgatacacgcctgctgtcagtaagctgatggcaataagcacagctgaaaagagacgaaggtgctgacgtttttccgcatgcatccataggaagaacaagctgatcacaagcagtcctatacctgtaaacacaacgacatccatgtttccctttgctcgttctgaaaggacgacagcgagaaggaacacgatccaagcgcctaagaccgcacgctttttccacttccactcgatttgtgagaaatgcttgatcgtgatggcaacgaccgctccaactgtaaaggccagaatgtattcaaatctgtactgcggtgcagaaaaaccattaaacacgctcgccatctttggactgtagtgaaaaacaatgagcagcatactgatggatgtaaacatgaaaaaccacctgttccggtaaagcggaacgaggaacatacaaatgagaaaaatcacaggtaataaatacaccctgctcgtaaacagcagatgatcatgcagctcgaaccaaggaatggtctgttcatacggcggtcttatattgttaagaaagccataaacagacgggataaaaaaggcggcactgatcccaaaagataacagcgtagagatcgcaagtgtccaaaatactttccacccgtgctcctcacttcgcagcttgatcatatatctgaagacaagatagatcgctaaaaagataaagtgaatataagcaaagtaaaagttgttgatcagcatcagactgcaactcgcaaaaaaccaagcgggcttacccgttttgaatatccgctcaaccccaagcacaagcagcggaagccacatcatgctgtcggtgaaaaattcccaaaacgtttgatgccggaaatatacaatagataatccatagattgcggcacctgtcagtgcacccaatctattttgaaccattgaaagaagcacacggtaagcgatgaaaagaataagcgtcagcttgatcacgctcagccaaatgacggcatttgcccaaaaatggatgtctgttgactgtatgagatggagcgcattcatcagccagacgacagcgactgtcaccataaagaccgtcgacgttgtgaaataataccctaattgcgtgtatgtaccgccgcctagaccgaattgataggaataaaagaaattccctttgacgtattcgtcgtaaagcagctttttaaatgggagcatttgcgaaatgccatccccatctcctgtcatgtaccggccttgcgtatattcatataagaaaaaggagtggcctaataatgcgagaatgaggcacattccaatgattatccatctacgtttcatcatctaaatcctttccacaaaagatccattgttctttgaaacaaaacaacccagcaagcgattcgtgcttgccggttatttgactccacgttatttaaataactgcgttaacactcggtcttgttccttagagcttgtctcttgctgcatgacatttgattcttggatcaaataatgcggcctctttttcgtttcataataaatgcggccaatatattcaccaatcacacctagactcaaaagctggacacctccgaggaaaagcacagccgatattaaagtgaaataaccaggtactatcacgcccgttttgacgatttgaataaaggtggccacgatgtaaatcaaagagaggaataagatcagtatgccagtataaaaacaaatacgcagcgggcggttgttaaaggaaataacgccatctatgccatagttaaacaacttctttaatgaccattttgtatcaccatgctgtctttctacattttcataatagatgaccttttcttcaaacccaatccagcaaaaaagccctttagaaaaacgatttccttctttcagctgaagcaatgcatcgattgcttggcgcgaaattaagcggaaatctccgacgccatcacgcaagtccacttcgactaccttgttcatcactttatagtacatggatgataagtaagagcgaagcttgctgtctcctttacggttccgtttggcaatgacttgatggtagccttcttcatatcctctgacgaagtcctgaatcaaatacgttgggtgctgcaggtcggcgtccatgatgatcgcagctactccattcgcatattcaagtcctgccagaatagcggcttccttcccaaagttacgtgagaaggaaatgtatttgacctttgcacttttgcgagagagttctctcatatattgaagtgtattgtctttgcttccatcattcacaaaaatgatttcaaagtcataatgaaaatcgcgaaactcttcctcgagtgcctcaaagattcgtctgatgttttcaccttcattgtaagaaggaattataacagagagcaattctcgttccatatcgcaccttctcttcacttttttcacatagtctgatatgttcattattccttttttatcaggaaacgaaacccttttttattatccataaattacatgtttctttaatcgttccattatatcaaagttttatttccattgattttcagcaagatgaatttaatgtaattttaagtttaaccattgtaaaaagcctgtaatttcgatcacagactgggtattgtatcataaaattgtttactcatttatatattttcctatttattgaaaaagatgaggggcacttcttttaatgaagcagccctttattctgctcttgtagatgctcgtttgccttcgattgtttattttggaataaatgcagctgcgcaccgtagctctcaatccactcttggacaatccgttcagttgtttcctgtcctttatacttgtggccagcctttgcataggtcgtttcaaaatcactccaaagcagctctacccatgtacgtgcttcgtcatatgtcagcatattgtttttttccatcagttgttctgttaatcgctcaaagtattgttccatgtcggttcctccttcatctagcagaaagtgcctttttaaaaaaaactcttttttcatatactacccttacgtcttcaaaagacgcaaatgatttgtattgtttggagggaatcgaaatgcgtaataaagcaaaaggctttccaaatcaagtgaatcacaaatttgaaggcgagccaggcgccacagatgcttatgcgtctaaaaggccgaatggtgagacgaatacacgtccacaggaacgaatgagggcatcagggaaacgctaatttttccaaagggagtgcttgagatatgagttcaaatgggaaatcgtatatggaagactttgttcaattaaggacaaccgcttaccctcaaccatgggcgaatgcaaagcattctgcctctcaggtcaacggagaaacgcagcaaacgcagcacgacatcgtacttcagaacaacgtccgtaaacaacgttcgaagtaaagaaaaggactgatctctcggatcagtcctttttcgtaagcattgaaattggcagtgcatcttctttatttggggctgatactctgtatccccacgcaaatacaccatttaaatattccacgtaaaactcttcatctgtatctttgatttgataagtcgttttcgtttgaatcaaggctggatctactaagtaggctttggccatatcgattttccgttctaagacggcatattcattcacaatgccaagctgctcagcctttcgtgctttttcagaaagagaggctatctcctgctttaattcgtattccgtcatctcactataacgtttgtccatctgtcattcccctttgtctaaaacgtgatcaattgtgtcgagatcaaagccttttctgaataaaaattgcttcaccttcatcttcttttcaaatgacccgtcgtatcctaccttgcgttttgccttctccatcatataaaggagcgcttcttcttccttttcctcttcttgtccatcataggcttcttgaagggctttatcaatgatctcaaacgaaaatccttttcgctgcagctgcagcttgatgcgctgctcgatctcttttgcggaacgatttttttcttttctcacaagcttctgaacctgcttcacagcttcctccagctgtaagtcatcaggatattgcgatagtgcttgttcaatgttgtcatcatctatccctttgagctttagctcttttttcaggacggacggccctttgctgttcgttttacggtgggtgctgacataggcttccgcaaattcaagatcatttacatacttgtaatgctttaatttgtgtataatttcactaatggcaggtgccgggatttcttttttcgtcaagtaatctgtgacttctttcaccgatctcattcggtaggataaataatcgacggcctgctgaaatccttttttcacagcatcaccgaattgaatgtcgatgatatcggcttcgtccagctcttttccctttttcaaatcgtgctggacgagcacatctagatccacgctaaacgcgtacttttcatcaagaaagatgtttacccgctctgtattgtttttctgagcggagatttttgtaatatagggcatcctgtgatcactccttttttcaaacagtcaggatgtttcttctgattcaaattcgtgaaagatataggtatgtatatgagaggagagatgtcaattgaatatcgccatcaccggaggaaccggttttatcggccagcacgtcacgaaagtgctcgctgctgaaggacatcatctatatattttaacaagaaatccaaaggaatccgaacaaaatcatttatactatgtgcagtggctgacagaaggtgctgcgcctgagcatgaattgcctgcgattgatgtctggattaaccttgctggaaaatccattttcacccgctggacagacaaggcaaaagaaggcatcctctctagccgtattcaatccacacaagaagtaaggcgcattatagaagcgcaggaatcgaaaccatctgtgctcattcaagcaagtgctgtcggaatttatggcacgtctcaaacaggagattttacagaggaatcacctcctgcggatactgatttcttaagtcatacatccaagcgttgggaagctgaggggcaaaagattgaagcactcggcattcgtaccgtctacacacgcttcggcgtcgtgttaggagaaaaaggtaccttgccactgatgacactgccatataaactatttgccggcggaacgattggctctggctcgcaatgggtttcatgggttcatgttgaagatgtagcacatctcattgcttatgccatacacaatgacgacatctcaggtccactcaatgtcacatcaccgaatcctgttcaaatgaaacagcttggacaaacgatagcgtctgcccttcaccgccctcactggctgaaggtcccatcctttgtcattcgaacggcacttggcgaaatgtcattacttgttttagaaggtcagcgtgcgctgccgaagaaggcattgctttcttcttatgactttttgcatcctgaattaaaagaagcgattttgcattcaaaggaataatttttgtcaaaaacacccatcctattagaaatgagatgagggggcgattttgatgaagaaaaaagaacaccagccaacttcaaagctgaagaaaacccaggaagtcctgtatcagcaggaattcaaaaaagcggaaagagcagcagaaaaaagaaacaaataagatggatattccactccaacaagcacataactaaagtgatcttgtaaaggagggaaaggctttgaaaaaagaccaacaccaaaaagccaatcacgagcttgcagcacaagagtcggatggcgaatatgttgaattttccaaagaacttgcagatccgaatgacgtaaaagcaatggcacgtatgaaagcagccgaccagcgcgccaaaaaacaataagtaaaaagcagaccctttagcggtctgcttttcttttatttgatttcagtaagaagacttgatgctttctgacgtgatttttcctcaggcacctcttctggataaccaatatgaaggatggcagcaaaccgctcgttttcctttagacccatgtcctgttgaaagcctttgtcgtataagatgcggccgctcttccagaccataccgattccttgatcccaagcaagcagctggaagttttgaatgagtgcgctcacagcggcaaaatcatcatttctcactactgggttttcgtcttcctttaacactacaagtaaaagggctggaacttttgaaaagtaatctctatattgattgatcttttcttcctttgcatctggattgttgcgtttgaagaacgcaacgaagcgatcaacaaatgtcgctttcgcttcctccgtcactgcatatagaaagcgccatggctccgtaattttatgattcggtgcatagaccgcatcctctaataacggctgaagctgctcaatggtcacaggcgtttctttgaacttccgaatggatcgtctatatctcacagcgtctcgtaccgttaacgcttctgtttgttgtttgatttctggcatatgtgtcatcctttcaatcaatcttaattgaaattgattctcattcacattataaacatcatttcgagcagttgcaaatgatgtttcccctcccgtctgctaaaaagttgtttgagtttttcaagtaatgttacaatcatattacgttttaaacaaattttgagaaaaaagccaagatgatgaaatgatttcaggtattcccattttgtctgattcggttcttttgtcaaaaggctttcaacccatgattggaagggaggcttctggatggaatgaaaatcaatatcgggcaaatcattaagctctaccggtataaacaaaatatgacccaatctgaattggcagaaggaatttgttctgtctctcatttaagtaaaatcgaaaatggctcaaaagaggccaatcaagatacgatcaatttactgcttgaacgactcggcatcagtcaagaaacgctgtcacaaaaggcgcgtcacctgctgtcactcttggatgagtttcaaatgaatatgtatttctatgcactcgatcaagcggaacaaaatgcagaaatgatcattcagcacgaggaacagttcttttcgctagatttaggcattcagtatcatttgtccttatttcaattttatttattatcggacaagcagccgcttgccttaaaaacacaccgcgtactgaaaaagtttgaaaaaacctttattgaaacggaaaaagaaatatttgaatatctagatggcattcatctcattaaaaatggtcagcttgaagaaggcataaagaaactggagagctgcttttcttatgcgtctgttgaacaaagtgacctgtattatcactatgcaaaagcacttggaaacatgggacatcttggtgatgcgcttgaagcaacccatcaagcgatggatttatatagacaaaagaacaatttcaaacggatcattcactgcacactcattcatggcgtgatctcactggaactaaaagcctttcaaacagcgaagaaatatttaaaagaagtgattttgcacacatccctttatcctgatgcctatattaaaatgaccgcatatttttattatggggtacttttaaaacgggagggtgatttctcttcagctgtgccttatttactagattcactcaattactttaatcaagaacagatagaagaccgttactgtgaaactctgtatgaaatcgcgacattatatgctgaatacgaccgcaaaaaggcacttccctacatacatgagctgttaaaacagcctcgtattcagccaaactgtttatatatgatcaaaatctataaattgatgattgaggaaaaccctcttgatttgaaaacctatttgatcgaagcagcccttccttactttaaacataatgagctgcacagtgagtacttgtttgctcttagaaccttgctttcctatgcgtcttctgagcttgacgaacgtacctatatgtcctacacgaaaacgctgcttcatcatcttgcatcatatgtcccctattacaaaaaagcatgaccttctgccgatcgaaggtcatgcttttcctattcattaaatggtcttctgttgatctgtatcaggacgggtgacttgtttgactgaatgaacataccgttttctcgcaaagtaatcgtacgcatgctgcccaaagcctaaccaaatgctgagcacgatgaatgggatcgttccccataatgcagggatattgcaagcaattttcagcaatgtatagatccccgaatttttttggtttttggctaaggaaattgacacgatccgcttttctgccttttcttcacttattttgttcagtttgagcagctgcgagtgtcgaaaggattcaaaatgaatacggttcttccaatcgagagcttttaacaagtctatcgcttttgcacatgaaggactttgcccgtcataaaacacaagcagcctaagtgatttgatggaacgctgttctctttttttcgattcagcgagcttctttttttcttgatcgagataaatgatttttttcatagattgatcgccagcccttttccgtcatttgtttttttagttcgttcaaaggagattacaactagattactatagttgctgggcctcttgtattgggaaaaagcaaaccaacgtgcgttatatgagcctttagataagggcaaaattaaggttttcatggcacatatgaggtttttcaactaaaaatggttgggaaaatcgtgatgcgttgcggttttctgcggttttttgtagaattctgcggtttttctacatctttatgcggtgttttgtaggtgaaacgcaaaaacaagataaaaaaagactacttcccgttgcggcgaagtagtcttttggtttatattttttccaaaacttctactatttctttctcaatatctttccataagtaacgatctgtcgtatagtgatgtgcggcttctttcgcaaatacttgaaaagcttcctcaaaatcaggagcatccttgtctggttttttctcatcaacaaagcgctgtgcttctgttgagcgtggtccccattttcctacttcattcccgtcttgatcaatgatcacgataatcggaatcgatcttgcggttccgttcgttaaatactgatccatcaggtctagatgctcgtcccgaatgaaatagcgcgcttcaatgagtgcttcacttgcaatacgcatgaaaattggtacattgaccatcgcatctccgcaccaatccgctgtgatgacaagcgctctgagctttttcttttgcagcttttgaagcagctctttttctttttgatgaattgcgtactggttgtacaccgtgagtagattttctcggtttttctccatgttgtgtacatatgtacgttcagttaatccctttgcaaaccattcatttaatgtcatatttacatcccccttactcttcaactttaccacttttgctattcttttgtctaaaaaaaccttcacctagtgaaaggtaaaggtttttgatctatggacgccggctgcgatttgggtccatccctatcagcttggtgacaagcaccattgtgacaggtaaagatgtattctttttatacgctaaatattttccgcgccattcaggtttatatttctgtttaaacgatcgtaatccactgaagctgtacataaatctgacgttgttgaaaataacactcgccaaacgctccgtgagaaaggactgatgaaatgttcctacatttgataaaggcgccattcccatgttaaaggatttgtagcctttttctttcgcccattgaaaaaggtggataaacagcgcatccatcatcccgttcggtgcatcatgcatatgacgcataaggtcgatcgatatctccccttcttgatacatcggcattaatgacacaaaagaaatgatctccccatgttcatccttcagtatcgcaattggtgctttttgaagataatcttcttgaaaatagccgagcgaaaaccctttttcttttttctttccaagccagctatcagaaatctgttttaaggttgagatcagctcatctgaaaaaggaggttccagcatgtcaaacgtatagccttctcgttcaaacttattggccacagcccgtaaatttgattttttcttaccggagagagagaacgtttctaaatcgaccatggcttcttctccaagcttaaagaaatgaaagcctaagtcatggtagagcgccatcccttcccgttctacttgataaaaagcgacgcgatagcctgctttttctgtctgctgtaaaaactcttcaagcactagtggataggatgctttacgtccagaaggatctccgagcacaatgacgcagcggccaatgcgtccaaattgaagcatcgcctctccatcacttgagaaaaataattttttatcgcctaaaaagccaagatgactaagggcattgccgcccttttcttctaaaaatgtttttagtttttcctcatctgctttttctccaatcggaaatgctttcttattaaaaatcaatttactaatgaagaagaaaagcggtacaccgataagcgcaatcatgcttgtcatcgtgatgtgccgttcattatgcacgaggtaatccttactcaagaaatgcccgattttggtccaaataaagttaccgatgacattatagttaaacaggacgagtaaataaccagcggcagccgctacaaactgatacaacgaataaggagcctgctgcttcacaaattgatttcgaagagagaaaaagacagccatgatgactggcagtataaagataagacttaagttaaagccttttaacaaagtaaacacaaagccgcctgctagggcgatcatcgtcagcacgtatgatcttttcgttcgtttgtacacttcaatggacaaaaccatcaggataatgccgaacattaaagaaagaccattaaatcctgataacaaaaagcgtggaatgctcgtaattacacctaatcgatcgacaggaaggacaacagacgccataatgagcaagccgcttccaaaggttaaaattgataatgatccgtacagtaaacggattaataaagcacggtgcagcacaattaagacgttcgttgtttctacggctggtgccattctgggattgccttcaagacgtctaagcgtcgttcccgttaaatcataagcagctagacaaagcccaaggataaacgggaagatcgagtacacgaagcggtacaaaacgagcgccgtcagcaccatctctttatcaaacccaatgtactgcatactcaataaaaagatgaggtcaaacgaaccaaaaccgcccggaaccatactgattaaaccgccaattgacgcaatcgcaaatacgcctaatacaatccggacatcgacattcatccccatagagacgacagccatgtacatgacaagaccagctgcgagccattctaaaaacgatgcaccaatataagcgtaaatcggatgcttcagtccgctttcaccgctctcaattgagctttttcgtatggacgccataatgatgtaaataggcacaatacaagcaaagatgatcacaaaagcccacagccacggctcttggctgataatactttcaacaggaagcaccctcaccaagatcagatcgctgaaaatagataagcccaaaaggaccgaggaagtcaaaagggcaatgcctttgagcagttttttcgtatcggttatgtactccttatatagaagtgttctaagccctgctcctgatagaccgccgaacccaaggacactgttaaaggagttcgcaatccaagaaatgcgaatcgttttccagccgctgatgggcatattcaggctttttcgtaaaataaaatcatataaggacatcgataacactgcaaccagtccaagaaagacaagaataaacaagtccattcgattcaagctgtcaatgatataaaacgtttttttaatggaaaggccgctcagttccttcttggcgacaaaaattaagacaaggataatcacgatcggaaaaagcatttttaagatcgtcatacccgtttttttgttccacatgtttttcccaactttctaagttgcttcatttatttcgactgaacattattatacaacaaataccacttgattcatgcagtttaacattcaaaagcttgacgaacctttcaattagaagtaaaaatcagtaatatagagaaaagagccgcttaaaggaagtgaacaagcgtggaatacaatattcatgacaccacagtattaaaagaagagattctatctccagaggaaaaaaagacatgggtgctttatatgaaagtactcacagctgcaggtcttggagatgtgtcagaatggatgaagctcgatatgagtatgcctcaaatgaaggtactcatgctgctcaataaccatggctctctcaaggtatccgaaatcgctgaaaaaatgggcgcttctttgtccaatatgacaggtctgcttgatcggttagaacagtctcattttgttgaacgaaagcactctgagcgtgaccggagaatcattgtcgtcgaactaactgaggaagcgaaaaatattttcagaagcatttatcaaaaaggacacgaaaaaatcaaaaactccctgcaacggctcaatgacgaggaaaaagaaaaagtcaacgaagggctggctattttagaaaaagcactgcgtcctgaacgcggctaaacatgaaaaggaaaaaagacggtcacttgagatccgtcttttttagttcttcttctacttgtttatctgagagaatgaaggttttttgaagaacgactctgtcatcccataaaagataggctaaaccgatgatgagaaatagaatgctgatccacgtaccgccagggagcagctgttcaagttcctcaatcgttctttctgagcctaagctgttactatagcgtatctcaaaaagcacatatttcgctaaataaaacaatgccgccatacagataaacatggcgccgacaattcttctaccagacatgcgtttactcctttaattccactgatttcttttgattaattccgtgatatgagcaaggtgatgctttgagtgccagacgtacatacctgttgcatcatataaggataccgtttgttgatcggctgggtgataataggacgcagtgaagtcttcttctgacatccctcgaagtaatgtcacccacctgcgatgcagactgctgattaagggcagtgataggctgatgggcgctttgctgtctggaagctcggcgaatcccgcctgatcatatggacgtatgtgcggtgtttcttctgtgagcgcaagcttgaatcgtaagtatgcattcagatgactgtctgctacatgatgaataagttgacggacagtccatcctccaggccgataaggtgtatccagctgagcagctgtcaattgattggtgaccgtttcatattcttggggaatctcagccaactgatcaatccatgactctagctgttcctttgttttattttcaaccggttcatataagccaatcggatattgtaatgacgtcataccctctcccctttctcaaatccttctagtacaaatttaccaatcatctttccttgttcaagggtttgatgtgcctgcttcaagttagaagcattgatcggactgagaacctttgttaaggtatgcgttatttttccctgctcaaataactcacccgcctctgtcaaaagctcatgctgtttgatcatgtccgctgtttcatacatagggcgtgtgaacatgaattcccatacaaatgccgcacttttatttttgagtaattgaatgtctaggttgtgctgattctcgacaatggtacagatcgtgccttgcggttttatggcttctgccatgcctttgaaatgtccgtctgtatcatttaggcataaaatgaaatccacttcgcctatttctttttcctgaagctgcgcaagaagcggctcatgatgatcaatgatatgatcagcacctaatgacagacaccactctcttgtttcaggtctcgatgcagtggcgatcacagtggcatttgctaatttggctagttgtatggcaatagaacctactccgcctgcaccgccgatgatgagcagtgttgccccttctgcatttcgtttcatatgcatccggtcaaataacgcttcatatgccgtaatcgtcgtcagaggcatcgcggctgcttctgcaaaggatagattggcaggcctttttgccacaatccgttcatccacaagctgatactcactatttgagccttgacgcgtgatatctcccgcatagtatacgtgatcacctggctgaaataatgtacacgcttcgccgacttcaacaactgtaccgcttgcatcatagccaagaattttcagtttttcttccttctgatccttcggtgatctcactttcgtatcaactggattcactgacacagcctctatcttcaccagtatatccctacccgttgctttagactcttctacttcctgatccatcaagctttgctcatgctcgatcggtaagtactccaatagtccaacagctttcactcgcttgcactccctttctctatgcttcttttccacattttatcataattttctgatgtttatgggtaatcaaacgagtgaatgcacattaagaactcttcaaagcctttctctcccttgctatataagaagggcgtgccttttgcaatgaaggaacataggaaaaccagcttgtggatttaaagaatagctgaacgtaataaaactggatgtgctgaagggaaaagagcatgaatagaaaaatagctagtaaaagagttaggtgatcagctgctccatgtatccattccgtgataaagaaaacaacaaaaccgatcatgatcaactgttccagcctttgcatgagctgggtcaagacatgtcctcgtttcgatagatcaccagactggcgcttcctgatctttctcgatttataaaaccaaatggtacattctactaagttatgagtcataaaaagagcgatgagggcgatcaataaaggtgatggggtataaaggacttgtgcaacgaatggaaacactaaaaaataacatgcaatacatgcgtgtctcactgataagagaaatagttctttttctatgtatggtttcatctgtttcacctccatatgtactacgtctgctctgccataaagttccctctgcttatcaaaaaaggatgccaaaaaggcatccttcctgaatcatatttaaaatgcagcgcttagtacgacaggtccttgcggcagcttgttatccttttttggttcaagggtgactgccacggtatcccatgattcgcttgcttctttttcagataacgcataggtgacggttccttctcctttgttatctgttttaaaggcaccagctggtaccggctgatctcctttaatgagccacacttgataaacagcagatgaatcaagctgatcctttaatccgtctgcactcacaaccagctcttttttgccgttatgctcaatcactgaaaaagcacccgttgtttttggtgatgcggctgatgccagtgattttgtcgcaacaactctgacaggttcttccgcctgttcttttccattcaataagaaatacacgtttccagctgctgaaatgagaagcagtgcggcaacgagcggcaatagccactggtttcgtttcttttgaagtggtttcatctcgtttggttcacgtactgccttgaggtcttttctatggctattcttttcttcgactgtctcttcttcaaacacctgggataaaatacggtctttcatccctgccggaggtgtttggtcacctgctagaaatggaatgtcagacatgagcgatgtcaattcttcaagctcttctttgcaagctgagcagtgcttgagatgctcttcaaattgtgctttttcctctccttggatatgcccgttgaaataatcaatcacttgatgtttacactgagtcatgcctcttcctcctttcctccgcgagacagtctcgtccgtaagtgcttcaatgacaatcgaactcttcccttcaccgttccaatggggatgcctagcttttcagcaatgcttttttgtgtcattcctttaaaatagacatcttctatgatggtttgctgttcttttgacaatgtagatactgcttcacgtatgatttgtttttcctcgttccattcgacttcctttgatacatcttcttgatgatcggctaaatattcaatatgctcatcttctagtgccgtttcgttccggtgctttcttagaagatcaatggccgtgttgcgtgacatcatgaataaccacgatgagaatttccctttatccgtatggtattctcctatgccgcgccagagcttgataaagacttcttgaagcacttcctccgcaagttcacggcttccagtcattttataaataaacgaatataacacacgttcataacgatcatacagcacttcaagcgaaggcttgtgacgatcaaatttgatcttgtgatatagctcagaatctttcagtgtatccatggtcatctccttcctttttcatgagaaagagcatgctgcattcatcatgaaatccttcacgtattgcttatcactcgatttgctgaaataagcctactttgtactttactcttttttcaaggagaaaaaaagagcgccgaaaaaggaaatgtgctcctcatgagaatgtacttactgtacgaaaagcaaggccatttggatcacttatatctaaaaagtcaagaatccatgtgtttccattctctgttcagttgattttagcaaactctcatgtccctcacaatggaaatgaagtagaacgcattttttcaacatgtcataatagaaggtaacgaaatgaattggagtgtccttacatgatgttgacgatcgttctttttttattagcaggaatagcagaaattggcggcggctatcttgtgtggctttggctgcgtgaagcaaaacctatcagcttcgggatcgccggcagcctcatcctcgtcgcttatggggtcatccctaccttccagcagttcccaactttcggacgggtttatgcggcctatggcggtgtatttgtggttcttgctgtgttttggggctggtgggtcgatcgaaaaacgcctgatctctatgactggatgggtgctttgatctgtttagccggggtcagtgtgatgttatttgcgccccgcagttaattgtctcatgtctacaaaacaaaaagggctaaaataaggttattttagccctttgtcttcttttttagcgcaaaatttacattctaaattgtgtttcgtataaccggcggtacagaccgttcattttgagtaactcttcatgttttccttgctcttttacgccttcttttgtgagaacgataatgcggtcagcatgctgtattgtcgctaaacgatgcgcaataataaaggtcgttcgtccctgagccagctcttctagtgatgcttggataaaagactctgtctcggtatcaagcgaagaggtcgcctcatctaaaatgaaaatcggcggattttttaagaaaatacgtgctatggagatacgctgcttttgtccgccagataacatcatcccgcgctcaccaatgatcgtatcaagcccttttggcaaactattgactaaatccatcagctgagccttctctactgcctgccaaatttcctcttccgatgcatccagttttccgtataggatgttttcacgtatcgttccatgaaataaataaatctcttgctgcacgacaccaatttgagaacgcagcgatgcaagtgtcatctttctcgtttctatgccatcaattgtaatgctcccctcctgccattcataaaaacggggaatcagactgcaaagggtcgatttcccagcaccagatgggccgacaatggcaattttctctccttgtttgacctctagattgatgtcatgcagcacgggtttgtttgattcatattgaaaagaaacgtggtcaaaaatgatattcccttttaactgctggacttcgattgcatcctcatcatccttttcatctggtgtttgatcgatgagtgatgcgaatcgtttaaagccggctgcaccttttggatacatttcaatgactgcattaatttgttgaattggtcctaagaaaatacctgttaataggacgaatgaaacaaattcgccatacgtcatatttttttgcaatacaaaccatgcaccacacacgaggccaaataccgtgacgcttttaatgaggaaatgactcactgctgtatgaactgccatcatttgatacgttgtcagttttgtttttctaaactcctcgttatgctcgataaaacgatccatttcatgtgactcatttccgaatgctttcaccacacgaatgccgctaatattgttttccactcgtgaatggaattgtccaatgcttgaaaacatgttatcaaaagcagcagacatttttttcgtaaagtagacggataatccgatcaaaaatggaacgacaataaatgtaaggaccgcaagctgccagttaatcgatagcatgaggccaaacgcgcccgttaatgtcataatggcaataaataaatcctctgggccgtgatgtgccatctctccaatatccattaagtcattggtcatacgagaaacgagcttacctgttttcttttggtcaaagaagcggaaggacattctctgtacatgagagaatagctggttcctcatatcagtctcaatattgatgcccagcttatggccaaaataggtcacaacgtaatgcatggtggagctgataacgtataaaacaagcagcaaactgccccagaaccaaatggcttcccaattaccatttggcagtaaatcgtccatcactttactgatggctagtggaaaggatagttcgagtaaggccgccagtaccgcacaggaaaaatctaatataaatagtcccatatagggtttgtagtatgaaaaaaagcgtttaaacaattgacagacctcctactgatgagataaatctgtcaatatatcagcaaatttttcagcttgattcatgactgcaattggatcataaggccaaaagaattctgcatctagttgataggtttgctcttttttgacagcttttaaactcttccaaatggaattatttttatcaaatgtcccgccatttgattcatcaatgaatatataatctcctgcatatttcggaagggtttcataggagagtacttcgtagcctgttttactgtttaaaattatatcttcgacctgctttggtgggttcatttgcagttgttgatatagtgcctgtccacctcggtaaattccgttcccatacacatacacatcgtttttaaacgcgcccatgatggaaactgtgtcattctcttttaatgcagacttcactttttttcgagctgtttcgattcgttgatcaaaggaggcaagaaacgcctttccttccgcttctttgtttaacactttagccaaagtcttgatttcttcctgtgcatctttgaatgaattgtaagggtatacgagtgttggcgctatttttttatacacatcatagactttttcgtcctgtactgctgtgataatcagatcaggctttaagctaagtactttttcagctgaacgttcgtcactaatgtcctctattcctttgatcttgtccttcaagtgtacattctttaaatcttgtgttgttgcacctacagggtgaacatccaatgcaatggcactgcctaaatatccatctatgagaatgcgttttgggtttgccggaatgtcgatttttccttttacggtctcaatggttttcgtttgttcctttgtttctgccgttttggcttgttctttatgaccacaggctgacaatatcagcatgaggatgacagcacatatccaatatgtctttttcatatgagtattcctccttcattccctgatataaatgagaatagttatcaattactagtctcatgtattctaacaacctcatacgaaatggtctatggaggattctcgcaacttacatatggacaattgttggatcggctgcctgagttaattgggagacaaatcggttcattaaatgaatcacccgctccccctcatcaaatcgaaactcctctagctttagtggatagaaggttccgtttttcacagcagataattgacgaagaacatcgctttcctccagccgctgatccatttgttcataccacccatgttcaacacttacaataaaaaacatgtgatccgcctcgaattctcttagcctctctaaaggaatgactgtatgttgattagggagaagaacttcttctagaatcgtcttcggaggctttaagtcaagcgtttcataaaggtagaaggcgcctctagcatcataggaccacatatacactttgtcatgtcctctcatttcataaatcgccactgtctctccttttttcctaaaggaagatagatcatttcttgccttctgactcacatgtttgaagcgtttcacccaatcatctgcctctttctctcttcctaacaggcggcctgtagataagacttcttgtaccacatgaccaccgccatatggcaaaacaaggacaggggcaatccgctccaaccgcttgatcaactcaggcttcgaataaaaatagttaggaatgatgattaaatctagttgaagtgatttgaaaacgtcatcaggcgtgtgttcatctatgaccagcgcacctgccagctgatctttgagtatatctgaatgaagaaaggtttctttgtcaatgcagacagggcgaatgcctagcgcgaccaatgttccgacaaattgaaaagcagcaatccgctctggtcttcgattgtttcggaactgactaggggtccttcctgtcttccgcctgaagatcctgctgaaatataaactgtctgtatagcccacttgccgcgcaatcatttgaatttgatcatctgtttgcagaagacgtttttttgcttcatccattcgaatttgggcaatatagtccgtcacacttagtcccatactttgtttgaaaaaggtcgaaaaatagctctcatgaaaacccatcttatgggctaagtcttttctcgttagctttttttcataatgctgcgccatatattgcaaaatcatttcaatagaataatggaccttctcagtgtatggcttggattgacggtgaaagatgtgcatgatgtcctccagccccttcacctgttcttgggtgctttgactcgtcttcatttgtttgatgcaggaaaaaagcatggcagagcctttgaccatcgatccattatccgggagatcgtcataattcatcttatagaccaattcattttgcgcatcatttgccagggtaaattggttaaatgtgattgtgtgaattgacaccacctcgcttgataaagattggagcatgacgtttatacctgagcggatcaatatactgtcttttgcgtttagctgatattgtaatccttccatttcaattctcacagatccatcgcaagtcaagaacataggggaagatgtttgccaggagactgtttgtttgtcagaaagagatcgctctctactttctttcatgcgcagaatggtatgagtacgggttgtcattttctctttctccttccatataaaaaaagtgctaaaattttagcacttcaatggttgactggatgttcctgttcattaacgagcgccagccgtttgcaattctttgtttttctctttaaagcgttcgttatgagaagaaacatacgccactttttcggcttctggctcgatatacagctttgcgctattgagcgcattgactccgtcaacaaatgtcccagcaattaagcggaccttgcttttatgtgtacataaatcgcctaccgcatagacgcccggtaaattggtttccattttttcattgacctcgattagtccccattcaccttgcttgagtccccattctgatagcacgcttaaatcgcctttcataccgtggttgacgatgacagcgtctgtttctattcgttcgatttcacctgtctctaaatgttgaatagtgacagcatcaattttgtcaccttgaccatgaagttccgtcagttcatgcggggttaaaattcgtgtgcaagatgctttcatgttggcgacgtttttctcatgtccgccaaacatgtcacggcgatgcacgacggtgacactttcagcaattggaacaagggcatttgcccagtcaaccgcagaatcgccgcctccagagatgaccactcgctttcctgcaaatgtcttaagctcctgcactgtgtaataaaggtttgtcacttcataacggtctgcatgctcgatttcaagtttccgctgaacaggaataccgtggcccattgctaaaatgagggtcttcgtcaaatggcgatcaccattctcagctgtcagcaaaatgttctgatgttcatcgcgctcgaatgacgtgattttttgattcagtgcaatctctggttcaaatgttttcgcctgtgtttccagctgctgaatcaactgttcacctcttgttggcggcaaaccgcctacatcccaaatgaccttttcaggatacagtaggattttcccgccaaggctttcgttatactcaagtaccttcgtctttaaatcccgcatcccactataaaaggcggtgtacattcctgctggaccgccgccaataatggtgacgtcaaacaattcaagttgttctgtcatttgagtccctccagtttttcatcgattgatctatttataagtgatattgattctcattatcatatgtacctattgtagtctactctggtgaagggaatcaatagctttctgcaaaaaagaacaggacgagcgctttctcgtcctgtcctccatcacacaatcgttaatccaaggtcctttaattccagcgaaacaagtcttgcaatcgcatctgctccttcttttgtaaagtgcgtgcgatcctctatgcctgttgacagcataaagtaagaagtcgttttctctatgccggaaatttgataaaactgaaggcttgccgtatttaaatctacaagaaggacttcttcttcatcagctagttctttcatagcggcacagtaatcagggaaatcattgatatattctccgtctttttcatgaaagcggccaactggcgttaataaaagcggtgtagctcctttcgctcttgctccgtgaatatattgagacaaatagcttttatacgttgtgaaaggatctgtatgccgttcgggcttctccgttgaagcatcattgtgccccatttgtgtaaacagccagtccccaggctgaatgtcagccaatattttatcaagccgtccttcttcaatgaatgtttttgagcttcttccaccgattgcgcggttgtcgacgctcacaccctgcgctgtgtagcgatgtaaaaactctccccaccctccttgaacaggacgatctgggtaagatgaaacggttgaatcaccagctaaatagatggttgtcatgttcatacgccccctttttcatatagccactctaataagcgatgcggacatccaagtggctgctgaaaagatatgaaacaatcagcatcgctacttcattcattctctttttaatgatcaaaaccctgcttaccggtagatgtgaatacgttaaatatgcggcggaagttctatttttgtctcaacggcttgctttaacgcctgaagcatatagccaattcccttatatggagctagcggataaatcgctttctgatgaggaagtaataaaggatcgatcacctttcgatatttctttccacctagtatcactaattcatcatatgcagtgagatatttttcatgaaattgctgacttagtgcttctcttgttatctgatcagtatgcggtgtaccaaaagccacatcataattttcatgaataatatcatctgcctttaagaatccatgcttcgctgaaatgattaggtagtctgaaaagaatgtttgggcatagcttttcgtacgctgatgcagcggacttaaataaacgaggttcgccggctggctccctgcctctggatggacgtcccacattttcttcgccccacatggaatgatacaaactcgcttcacttgattttctccttccttcgttgatacatccgatacaacatacaacctagcgctgtgccaagtgtatttaagagaatatcatcaatatcgctgcttcttgtaatcataccagattgcgagaatatccattgaagcacttcaatcattgttgacaagaaaaagccagcaagaatcgccttttgccagcgcaaggttcggaatgcttgatagagaaaaaaaccaagtggcacaaataacaaaatgttccctgccaaatttaaaaaaacaagattgggatagccgtgatgataggcatggagattttgataaatggactgcaaaggcatgaggttgacactcacttgatcccttggtgcggaaaaacgattaggaaagaccgtcaaatacaataaaacattcgtatacataaacagacaggcaagaacgatttctgttcgtaaatagataaatcgtttgtgctttttcgcctgtctgtatctcatatgtagatagagcgggacgagcaagagaaaataagcaatggaaaacatcgcactgaatgtcatacggagagctgcccctttctcacatgatgcttgaccatatttacagcttattcaggcttgcctgcatctattcatcacttattctcctattcaatgacgagaaacccatattgacaaatcgtcatttttccgctaaactgactgacattcagtcatttaaggtcggtgatgatgtgtcgaaacgagaaaagattatgcttgctgccattggcgcgtttaaagaaaaaggaatcgaaaagacgaccatttcggatattgtgaaagcagcaggagtagcgcaaggaacgttttatttatattttccttcaaagctttccgtcatgcctgctatcgcagaacatcttatcgcacagatggtgcctgcgatcgaaaaggaattaactcagcatgcagatgtcctcgatcaagcagatgcgcttgttgaattcatcttctcttttacaagacaataccgtgacgtccttgctctgacctactcaggtttagcagccacggagcatttaaaggaatgggaagatatttatgagccgatttacaaatgggtcgctgcttttttagaaaaagcaaagcaggacaaaaaggtccgtgcgaatttgaactgtcaatatgcagccaaattcattatcggtttactggaatcgtctgctgagcaaatgtacttatttacagaaacagatacagaagaggttctgattcaaaagcgagaggtaaagcaatttctcctttacgcacttggcatagagacaccttaacttagtacagcacttgctgtacgctcttttttggtttcaaaatgacgaatcgtcagtttttagttttaggaggaaatacgatgaaaaaaagctggatgtatgtcgcactcacttgtttattcgaattactttgggtatttggtttaaataaagctgatgctgtgtgggagtgggcgatcattatctgcctgatcccgattgatttttattttttaatgaaagcctgcgagaagctgccgacaggcaccgtgtacgccgtgtttgccggagttggaacgattggtacgtctttgatggattatgcactgtttggcggttcgttttcattagaaaaactcttatttatgggtattttaattctcggcattattggactgaaagtgtctgatggagatgcacatgagcagaaaggagaagcggtataaatgggctggttttttgtgctgttagcctctgcctttgaaattggcggaaccattggtctcaatatgttcagtaagaaaaagcaaatcacgacaggcattttatttgttggcggatttgccctatcctttttgtttttatacgcctcgttctcttccgttcaagtatccgttgcctatacagtctggattggacttggaacggcgggctctgtcttgtttaatatgattctatttaaagagccgaaaaacatgattcgtatcctcagcttgctgctgattgtgattggcgtcgttgggctgaagttatttgcgtaattaaatcacaaaaaaggaagggatcaaagtcccttccttttttatttctcgtttaatggatatcttgctgctcgagcaagatacccattgcgtaaatcatttcgcctttttcatctaataaaaagtacacaatcaaaggttcgccaaaagctactgtttgctgcgtgaacaaaacacaggtgaatttttcgataccaattggaagctttctttttaatatagggtgaagaataggcgaagtccggattgtatctacatcaacatcccaacattcgttttttaaagttggataatgctctgataacaattggtgtaacatgtcggttgtgagcgttgcttttccatcgtacccatcatctattatgttggtgttatacatccgacggctgctcactttttgaagcattgattcgtattccttttaagacaaatcgtttctggccatcaagagtacaagtgatcaatgtcagttcatttttcccgcgatcctttagtacatcaacatccgtcggttcaattgtagctgagctgacaattttatattcgtatgttttcgcttgatgatgtaagacgactttttctcctttcggcacctcaggcagctgcctgaaaagccgatcgcctctataccctctatggcctgcaatcgtgaaattcccttcacctggcatttgatgagatttgatctgagttagtgcaatacctaaattttcttttgatgtaacaggaagcactttttcgtttaaatcaattgacgggatctctagctccattacatctcgaaggtcttcttctgacacagtgagatgtggaatagaagaaagggcatcactgtcattttcttctatcatctttaatgcctgttccattgccgctgtctcttgagaagttcgccactcatatataaaaggaacggagatgagcattagtcccgcgaccaccaaaaagctgcctaataaggttctttttttcattaatacactcgttccttccttttactgaatggttcttcttctaagaacaaggagaacagctccagatactattagtaaaatccctgcatacatcatataacgcagccattcttctccagtctttggcagctcaccgtttgagtcatggggcggatgttgatcccctttatctgaggctggaggattcgtgtggtcctcttcattcttcattggagcatttttcacaatcattgtcttgatctccacttcgcccatttgaattgtaaaagcgagtggtttttttaaagctacataaccatttggagctttcgtctctgtgagtgtatattcaccaggtttaagccctttgacaatggcttctccgtcttttcctgttgtcacagattttatcgtttttccagcttttgtacgaatatcaaaggctgcaccttttaaggttctatctgtctgctgatctacctttatgatacgcagacttcctaagatcaaatgattctttgctgttaattgaagtggcttctgctgatttttttcaattgtaaacaggatcggcttatgatccaattgatagccatgaggtgctttcgtttcaacgaattgatattctcccggttttagatcgttgatatgaagctttcctttttggtcggttacaagtgatttcttcaacgttttcccttctttactcagaagagcaaactctgcatgttcgagcgtatgtccctcatcatccactttggtcagttccactgctcccggcgtcagtttgttgatcatttctacttttgctggtttgtcttgacctaatcgaatcgtaaatgagacaggtgtctgatccaattcatagccggcaatgcttgctgtttcgacaaattggtaggttcctggcttcagttgatcgactgtcagttgaccgtttttgtctgtctttaagtctttcttcacacgctgaccgtgcgcatcaatcagttcaaaggtcacgccagcgagcaactgaccatcctccccttttttctcaagtttcacagcacttgtcgtccgaatattttcttttgtcactttcaccagttgatttggattgaaatcaatcttgaagtctactggttctgcatcaagttgatgtccaaaaggagccttcgtttcaaccaattggtaagcgcctggtttcaaatcgttgacagtgatgatgcctttttcgttggttgttaaacctgacatcaattctttaccatcgtcattgaaaagtgtaaattctgcgcctttcaatctttctttttcttcccctatttttgttagttctacagaacctttcttgagctgattgatggcctccacttgaatcaattctttttgacctaattcaacttcaaagacaagtggtgtcgcactcaattcatagccttcaagactctttctttcaacaaattgataggttccaggttttagacccgtgaaggtaatctttccatcctgattggttgtgattccttctcctcctgccactatttttcctttggcatcagatagatcaaagacaaccccttctaatgattttccatcttctccttttttgtgtaacagcactccacctgtagtgcggctattttcttttgtcacactgactagcttctcagggttaaatgggatagcaaaagtgacaggtgtttcgtcaagctcatgaccgaatggagccctcgtttcaacaaactgataggttccaggtttaagatcgttgacgatgatttccccgttttgatcagtgacaagacctgtttttatctcttttccatttgcatctacaagcttgaattctgctccttcaagcgcttcattcttttcaccaagcttcgtgagctggacagctccagttttgagatcattgatcactttgatctctgccggtgttttttgtgcgatttcgatggtaaacggataaggtttatttttcttttggtaaccatcaatactctctgtctctacaagctgatatttgcccggtttgaggttatcgaccaaaagcttcccatcttcatctgttgtcaaatctttacgtacaacttcgtcattttgatccgtgatttcaaatcgaacaccttgaagcttcttgccatcttccccttctttcatcacttctaatgcacttgtttcatataggttcttttgtgaaatgatgactggttctgttggatcgagtggtacttcaaatgtgattggtgtttcatctaatacataaccatcgggtgcttttgtttcaatgagctgatacgtacccggtcttagttcgcttatcgtgattttgccattttctcctgtgacgagcgaaccatttagctcatgtccgtcttgatctaagagcttgaactgtgcaccttctagtctctctccgccttcacctattttgctcaattcagcagagcctttgatgatgtcatttactgcagttacaatcgttgtttctgtttgattttctttaatggtgaacggccatttttgctgatttaattgatagcctttcggtgcgtttgtctccacaaaataataggaacctgggtcaagatgtttgaaaagaatttctcctttttcgtccgttttcaaatgggtttggacggtatccccagattcattttttagttcaaattctgcattctctaatgcagcacctgtctctttgtcttttttcgtgagcttgacatgctggcggatttcttggttctgcaccgtcatgctatttcctgttttcgcttgatctcctgattcgtaaggctgatcaattgtgacattgattggttctttcgtcttaatataaccatcaggtgctttctcttctgtcacgatatagtcaccatacagaagacgatcaaatcgaagagctccttcttcatctgttgtctttgttccaatgacgataccgctcgccgcatctgtcagagaaaagcttgctccttttagcgcttttccactactcgcatctacctttttaatggttaaagcgccaatcgctcctgtgccatctcccatgccagcggtacgtttgaccacaattgaggcttcggattcctttttaatttcttttacattttcacctctaaacgttacttcgttttgtagtgtacttcccaccttatctaaaatgagagattgatattctaaaatatatggtctcgtgatttcttctttaaatttgatttgaaaagaatctggatcgaattcaaggtctagctcataatccttccctttttccagctcttcctttttggtcacttgccccttttcatctattgtcgtcgaatacagatgaaatgagttttctattatggcttggttactgctcggatggtctataatcgtcgcatcttggactgttgattggccaaagttgatattcagtttccaatcaatgacttttccttgctgatttcctgatttgctcgtgtatttccctccatttggaatggacaccacagcattcacatctgattctttcgtctttccatcataaagggtcgctttattttcataggttttctgtactaaatccattccttcaacacttgtttgatacgtgattttgtatggagaatcaatggcatgtttgaaaatgacttcgaagcctgattctcccttttcattttcaaggaatttgatgtcataatgttctttcgctaatacctctatttcttccgctccattttccccgccttgtaaatcaagcgagtagacgatgattgaatctttaagcaaacgctgatttccttgaatgaaatcctcgattttcgcctcttctaaatgtttcaagttatagttcacaccgatattccatgtgatctcttttttctttgcatcatatgttccgttcttgaacccatttgactgcgtgtatgtgtcaggcgtgaagacagattgattttccttcgtcaaatccttgccatcttcatttacccattcaagctttacatgattttgcaggttcttttgatctttatctgctcttttttcataatcaaaagacgttgtatatgtgacggtatgttctgtcttgatttctttcataaattgaatatcaaaaccatttgcatgttcaacgatttgataatctgtgccttcctcaagcactgtattacctgtcgtcacttttaaactatctttttgcagcgtcaatccttcgtttgtaaacgtatcttttaatatcaggttgttcatggtttgttgatctttgttgaagacgatacgccatggaatggtcttgttcttgtaattcggtgttccatgatttttcgtcaggatttgctgatcaattctttgcttcccttgtttgctctctttaccagctgttacagtattgataatctcttcagcttcgaaaatccgctcggttgcttttgtttgatatgtgatgagataagccgattgaatatcttgattgaattgcaaggtaaacccgttttgttcatcctttttttgaggttgaaacacataatttccaaacgcttttgttcctgattctttaccatcctgatcaattgtgacttccttgacttgaaatgaatcagaaatcagcgcctgtgtgccattaaagaagtcttctaacaaagcatccttttcagcaatctttttttcgttatagttataacgaatttcccacgtaattgtttgtgtgactgggtcgtagtgggcggcttttttatttaaaggactgcctcttgtcacattcactgttccttctgctgaactaatcactttatcagcagagacaagggacgctttattacgaaacgcagactgatcttgattcgtaatgtccgtttcatacattaaacgataggctagatgcacgtcatctttaaattcaatcgtgaaatcttgaccatctgctgtttggccgattgtgtagtgattttcgtcaagcagctgaccaagtgatgtttcaccatttagctttgtatcaacacgataaagcttgattgaatctttctttaacgcttgaccttcttgaatcggatctaacagtttcgcttgtttcacatcgtctaagtccatattaaaatcgactgtccattgaatggtttcagcattgtaagatcgatttggttctccctttttcgagacgtttggaccatttggaatgtattgaatcgggatcgatatcgtatctttgccttcaatcggggtaatgaccacttctttttcttcagtaatgactgttttttgatctaattgcgtccacacttgaagtgttccatggatatttgaatattgtttaataaaatcagtgaattcgatggaggcatttccgctctcatctacagaaaaataaccaatggttgcctgattaaatttcatctcaagacgatcgattttttcataaatcactaattcctctggaaccttgaaatagaattcatccccgccattatagctatgaccatttgggatcgcccactcatagttaatggaaataagcgagttgatgtcaggcttatcaactgaatttccttcctgatcttcaaaaattaattttgcatcagtgagaagattttcttgtatttgcaattgttttgcaacactttgcaaccctacacgcttagatacgttcactttgttctttagtaattcatcttcatcgctttttttcgtttgagcagtttcttgattcttatcgtttttttcagatgaggttgagtcctcttttggaaggctttcttcaccctcattttgctttgttttctctttttgctcagctatactagtgacatcgatgtctattgatccttctaaatttggatcaagctcaacatcctctttcaatatgaccgtcacttcattttgttttgaaacggtatactcgccaacagatatgtcacccacagtaattagttccttctgctccttttctacctgtatgcctgcaggaagtgagagaacatacggaaattgcttttttagatcaattccttttatcgaccaatgaacaatggcctttctgacttgctgatcttccttgtttgataacttgtttccttcgctgtcagcaaactcaatatccccaaaaatattttcttgaatttctttggcctgtgctcctgctaaaggcaatattcccaatatacttgactgtatgactaacacggtgatgagagccaatgacaatatttttttcaatacatacacccttttctaaaattaattttcaacaacaataaaaaaacaatttggatactatctgataaatcactccgcttctgatcaaatatttttttaaaatagctccttaagaccctatgaataaaatgagttgatcaatcatgagcttgaaagggaatcatgagtagtggatatagtaagtatctggataggggtctatagaaatggggaatagtgagagggatcgtgaaaagaataaatgtgaatttttctatttatactggaatgaacaataaataatgtgtacatgcatatataagcatgtattcacatatggttcgttcatatgaaacaagcatgtatcatatggtatgtatggtgagacagttcagcatcatgtagatcgcattcctttctactccctttcatatggtaatcaaaaagctgctgcgttttattcttacatttaccgtttcaacagcaaaaaaataaacgaaatatctaaaatgatccatttttataggattcatggctcatttatcaccttttaaaagaaaaatatggagaatcaacgtataacatttgttttcgtctaatttttttctcttttatcatgaaaagtgaagacaaaacgatttagcctaaacattacaatcatttcatgcctattttgagaatcaaatgttctttaagtgaacttcataacatagaggcaatccaaggaaaggagttagttgtttgatggagctcattgataataaatcaaagagatggataaacattttaaaactgcttgtatccaaaaataagtggtggagccttcaagagatatctaatgaacatatcggttcggttcgtgccattcaaagcgatttagaacaaatgaaatcgttccaaacagaggacggagagccgttaatccacataaagccaagacaaggcatatccatttgttatacacagacgatacgagtcgactactatatcaaagaaattttaaaagatacgattgaaattcgattgattgacggcatttttttcgaacaaaacaggtctttctatgaatggatggacacgcttaatatcagtagatccacattgtataacaccattcataaaatcaattccattcttatctcttatgacattgagttacgcccagatagtatgcagttccatggaaatgagaaggagattcgtcaattctttgttgaatttttgtttgaagtgtatggaagccggctttggccattcgatgatattcaaaagcaagacgtagttgatttattacaggagctatttcaggtgcttgaagtcaatgtgccagatgtggcaatagataaatactgcctgtggtttgccgtctccattcaccgaatgaggaaaaatttcacaataagccgtaaatatacgtactcaatgaaagaggaaaaacaaaattctgcagccaaagggatctataatcaaatcaaaacatgggaagagcatatttgccgaatgaccaaagacgtatttgatgtgacgctggatcatcatgaatttgtctttttgctattgatcgaaccagctattggtcactttaaatcaattgaaactgtcgaagaaaaattgacgttctttcagtcacatacaccacgactctatgatgccattcattcatttatcaaccaattggagtcgatttttcatcaagaaatagcgaatcgcaaggtgatgacactcattcttctccaatattatgtgtattccaatgaaattaccgtaagagatgggttccttttcaaaaagaaatcgagctatttatcagaggtaaaaaaacagtttccttacttctattcgaggattactcatatcatccaagagttaaaaacagacgatatcctcggttcttttgtgaaaaatgaacgggaattgattcgtatcattacgtcttcatggagaggacttgttcatttggagatggaacggagaaacgcgctgaacatttttgttatttcaacattaggctattatcatagcttgtttattgctgatttaattaaattaagcgtgcctcctctcattcacattttcacaagtccagagaatacattaaatgatactacgatggatcaacttgggattgatatgattgtgactgatactgagcttccggttcaattcgggcggtctacgcttctgatcagctcttttccaacaaagaaagaattggacaacttgcaccgaagattggttgatatgatcgactaatgtatatcaaaaaaagctgctgaggagctctctagcagctttttgcttctgtattaatgaagcacgatttgttcattcatcaaatcaatggcataaagtgattgctcatattcatctaatagaaggtatactttgagtggtgcagcggtttgatcggtctgctgcgtgaataggacacaagtgaatttttcgaccccctctggcagcttgcttttcagaaaaggatgaagaataggagagattcgaagggtatcaacatcttttagccaaagttcatcttgtaacgcaggataatggtcaaccaaaaactgacgaaacacttccaatgtactcaaggtagatatcctcactttcttctatcatggcttcaagcttacctaaaacaaacatgtttaaagtcatcctatgatgccagtccatcaaatgttgtatactactagagacatgatttcatttttcttcaaatagcaatgtagatcaactttactgtcatgaggttttcatatgtatggcgtctactatattccaaccgatggacctatgatcatattcttatctgtttctttcgtgatgaaacgacaacttcctgctacaaaattccaaatttcttcaaaaaattggtgcattgagacaaaaaagaacagctcctcactgttctttcaaagaaaacacttcgccgctctctgcatcaacaccctcatggcaatcaagctttccgcacagaacatattgtttttgcgcttcgtcatagacgtagataggtgtaagttcaagacgttctctcaatttttcaaaggcttctttctgagttacagaaatttcacttgccgcttgagaggggctcagtatcccgcacacttgaaacatttcctttttatctatgtaatgaacggcttcaaacgagctggcgtcaatgaagaccttgatcttgtccataaacccactgccttcttgcccgttcgtttttaataccgcatggatgtatccatgatcacgatggagtgttttcagaacccacttccctgaatcctttggatatttttgcgccaagaaggttcggactgctttgatacactcggcttgctcttcttttgatatcgggaaggaatctggtgacggttccaatgagaaagcttgttcagctgaaatattctcatgaatgtctatttcttttttttcaaaggtattgtttaacggttcattccattcaatgaccttattcacatgtatacaatgcgtttcttcacgtccaatttcaaacggaatcgtgcctgttccatcgtttttcacataaatttcttctaacgcataaatagatcggattcggttgtgctcaaaggaaggccattgaaacagctgcacttgctgctcggctaaattctccagcttatcaagggaaagcgcatatttctcagctttcagtaatgttttggctaaaaatggaccgtggtgtgtaaagtacatgagctgtccatgttcatcccatttcacttcgattctgcctgaaggtgttactttcacaccatctattgcttcttcgaaagaaagttcccctttttccttctgatgcatataaaaatgctctccatagatcaaccctgtttcttgttcgatccattgaatgacatgggctggataaggtctcttaaacgtgacaccatgctgcgcataggttttgtccatgacaaaaataaccgattcgatctgtcctgtattcaaattcacttcaataacagcagtgccgtctgggttgacatcgtcatcctcaggttcagcttcatgagaggggaaccattccatattcaatgtataaatcgtttcattgaacatgttgacgtaacgataaaagctgtgtctttttagatcataaagatccaagccaaatttcgcctttgtctgatcgattagttgttgaatgtttgcattcatttgtttcacctcaaaatggttatgttttatggaagaacaaaggtgacaataaagccgactatgatgatcgctgataataatcctaaaaccaatgacatcatgtttgattcctttgtgaagccttttaactcaccttcagtcgatcggtcgatttttctaaagcgataaagcatgcttaaattaataaggactagagttacaaataataagaaaagtaaaagtataggttgtatgtttaagaatggattcgttacatcttggaaactaaatgactggagaaacatcagaccactcaataccactctcgaaatattttctaacctcttttctttctcccactcttcccctaatttttctttttcataaatggctatctgctcgaaaataggaatgaaagactttgttgagcctttctttataaaaccataaatacttagaaagagcatgataaatcctaaacaaagaaagaaatgtgtaaaccgaatgtcagacatttgaaacaagataaaaaaagcgaagatcatgatgcagactattaaattagagacagctatttggtttcttctcatctttttcagtgtagcttgttccatgtaatacccctctctgttttaaatgtttctgttgaacgctctatctttattacgattttactgaaaaaatgtttcaatattttccctttcaactgtcaattcggcttttttcgcaaatgaaagacgcccatcattcaatgaacgtcttatccttcttttgaaattagtacatcaattcttgagcagctgttctatcttttatttgttgagccgccatgtgtttaaagtcatcaatagacagctgtctagatgtcttttctccatgctgtctgatattcagtgttttttcttgcatttctgtatcgccaatgacagcgatataagggattttttgcatttgtgcttctctcattttatagccgagtttttcatcccgttcatcgattgtgactctgattccaatctttcttaattgctgctgcacctcaaggcagtggtcgaggtgaacctttgagacagggatgatttgtacttgtactggtgccagccataatgggaaggcacctgcaaaatgctcgatgagaataccaaggaaacgatcaagagaaccgaaaatggcactgtgaatcacaactggccgtaccttttcattcttttcattgatatatgttaaatcaaatttctcaggcatttgaaaatccagctggattgtggcgcactgatggctacgctgcaaggcatctttaatatgaaaatcgatcttcggaccataaaatgccccatctccttcatttagctggtaatcgacctttagccgatcaagcacattctttagcgctgattctgaaatatcccaaatggcatcatcccctaatgctttttctggacgagtggatagttccacagagtactcaaacccaaatgtccgatacacatgatcaactaattggaaaatccgtttgatttcagcttcaatttgatcttctctcaaaaaaatatgggcatcatcttggcaaaaagttctgaccctgaacaatccatttaatgcgccgctaaattcatgacgatgcacctgaccaaactcagccattctgatcggaaggtctctgtatgaaaataagctatttttaaacataagcatatggccaggacaattcatcggttttaaagcaaagcttgtatgatcaacttctgagaaatacatattttcattataatgatcccagtgacctgacttttcccatagctcttggttcatcataaacggtgtgctcacttcttcatattgcgctttgcttcgaacttctcttgaaaatgccattaattcatttctcacaagctgcccttttggtaagtaaaacggcatacctggcgcttcttctgaaaacatgaacagagataattgtttccctaatttccggtgatcacgtttgtttgcttcttctatgaaatgaagataattagctagttgttttggatgttgaaacgcgacaccatacactcgctgcaatacatcttgatgactatccccccgccaataagcccctgcaacacgtgttagcttaaatgactttacgaacccagtagaaggtaaatgaggaccgcggcataagtcgataaattcaccctgctgatacactgtgatggcctcttctgaggggagtcgttttaagatatctagcttatatggatcatgtgcaaacaacaattcagcttctttgtaagagacctcctttctttggatgagaagattctcgtttatgatctttgtcatctctttttcaattgcagccaaatcctctacacttaatgtttgattgagcttcatatcatagtaaaatccattttcgataacaggtccgattccaagtgtgacattgtcgtataaccttttcacagcttgggctaatacgtggcagatgtatggcgcagcacttcaagcccttcttttgaatcgagtgtgacaatagacagccgagcatcacaatccagctgatgactgacatcgaccatttgttcattgatctttcctgccactgctttcttccttaagcttgggctaatataggaggcaacatctgcgacagtcgtacctgcagagaactcctttatctttccgtctggaaattgaatcttcaccattttttctctcatgactgacacacctttcattttttgatataaaaaaacacactcatccctcataaagggacgaatgtgtaatccgtggttccacccaaattcccataacgcatattcgctttatggctctggtgccgtaacgtggcatagtcggtattggatacttcaattttccccaatacagctcaaaggcggtaagacaacttttctgcgttaggaagatttcagcgtgacttccctctctggtaaccgataaaagtggctcatgtccttttcaaagcaatgatcatagttgagtgaacaaaaaaacacacccatccctcataaagggacgaatgtgtaatccgtggttccacccaaattcccataatgcgtattcgctttatggctctggtgccgtaacgtggcgtagacgatattggatactatgatttccccaatacagctcaaaggtggtaagacacttttctgcgctaggaagatttcagcgtgacttccctctctggtaaccagtaaaaatggctcttgtccttttcttcgcttttaatttctccatatcttacatgaaggtgatggatcatgtaaagcattattttttgcagtgctaccgaaattcattctttaaatgatatgctgggtgtatttacttggactgtattcaatttgaaacgcagggaataaggctcgtttcacttcttcagtgatgcgctctccttcttgattgaatttcttttccatgtctgcaccatttagcaccaaatcatctgtctcttcgtcaaaccagcggccatactgtatgttccaattccagatcttcgagaaaagtgtatcgcttactggtacatcgtctctttctaaatgacattgacaatgcccacaatgaaaaggttcaccaccgtaatctccttcaattttcacgaaaggatgctccacaaattctcgacagcacacccattttttgaagtgctgaccgaactctgtcagtttaaacgagtaataatgcatggaagttcggctccctatcatgtcaaaaatcccttgatcaattaatgtcttaagtcgatactcaataaaatcatcgccgatatactgttctaaatgaccgatcacttctcctattaatcgtggcgttacgatgtactcctcttctggatgggactgatgaagccgctttgccattttcactaaataagcatcaaattcatcctctagtacgctgatcgtttgtcctttttgccatactctcagggtatggtgttctttagcaaataatagccattcgttttgtaatttctctctttcttcttttgacactgcgtgaatatgctctttacttctgtacaaaaccttcaatttttcagatgtgatttcccctgcatgtcgaatatccattcgtcttgtatttgtattgaacaacttgtcaaacgcagtcgttgtattaatgagagacaattcaatgtttttctcttttaataagtagatggcatatcgcaaaccaatttactcatgggcattattgcctatccagatgaggataagcgtactatctttgatatcttttatttgctgaatcattctatgctgatcgatgaccatgtcatcaaaatggccaaattcatttgacatcacgtgacgaagccactctatacgcttctcctgtccctcatgttcttgcaatttcagaagggggccaatcgaataaatgtcatgaaagacgatcatatcatttacttgctcttgcttcatttcgcagaatgcttgttttaaactaccggcagccgctgccccaaatacgatatgtatcattattcgtctccctttatcttacagtttatttcatcttcacctattcatggttcttgcgtcaattctattgagtcaatttcattcaaaagtatgacaatgagaagataagatatatagaatgcagaattgaagagactatatcccacgaaatggggctatatgtttgctgagctcgctttgagactttctctctgaatgattgattgatagaaatcctcttcattcagttcatgttcttatttacaaattccccttcacaatcgttctcttggctttcttcacaattctgctagttgcttttgtgtcagaatcctttgaccactggtcgcacaggttcgttacccaatttggttgtgttttactcgcgtcattgagccagtttcctacagaatcttgaacatatgaggatggatcggatttgagtaaatttagaatagggagtgccctctctggctcttgttttaataactcaatatgctttgtccatacccctctcggacggatcgactctacagagaaccggcgaatgttttcatcctcgctttttgcccattctgttaaatgctctatactttgatcaagctgaagacttagactttctctcactgacatccatgcaatttctcgaacaccaaaatgatgatcagctgcaaatggttgaatgtacgccagtttctcttttagtgttgataaactctgtttgttcatataagcagcccagcatcgaacgctatcagatacgtggtgagcaaatgcctgcagcactttcgcttgtttttcttcagtctcttcacgcagcacgtcatctaacaattgaccaatgagccgaatggctttcattcctgattcagctttttgtttagcgatctcagatgatacttcccctaaacgatggtctaaaccaatggacggcaaaacatgctgtattagcgtcatatgattgacagccagccattcagttaaattcacactttcgatctctccctgattcaaaaggttcaagacgtcatgagggatatcagttccctttcgagcgccttttcgattgatcatttcctcacttattggcattctgtattctctccttgtctacggcttagatattgacacctattgtagcaaataaacaacttcactggtgcattctttaaatcaaaaaggaactacccgaattaagtagttccttccatacaacattgaatgtcagttagcttccttgctcgatcaccttcaaactcttacgctgagaaaatcggccaaatgctaccattaaaatggtcataagtaaagcgagaaaaaccgtgccagcactgatccagcttaggtttaatatagatgtttcgcttagcacaaaccctcctacaccagagcctaaggcaaatccgaattgaataaatgatgtattgacacttaatgcgatatctggagattttggtacaagtgtgacaagatatagctgctgagctggtgatgtgctccatgtagcgatcatccatatcatgatgacagccaccataaccacgagattccctgtgacgaatgctagcagcatgagcatgatgatttgcaaaataattcctgtgaaaatcgtgaatattgggccttttttatctgctgccatccctccaaggctggagcccaaaaagctgcatattcccgctagtaacaaaatgccactgatttctgtgatgctcaggtttgctgatgcttgcaggaagggcgttaaataggtaaataacgtggaatatccacctacataaaatagcgtcactgccaccgcaagtaatatccgcttatcttttaaaatcgataactgcatacgaagcgtcaccggttcttgttctttcatagaggggattcgcttgtacacaacaatcagcggaataagcgtgatcaatccaatggctgcgaataatgctttccatccgattatactgcttagaaatgtcccgattggaacgcctaaaaccaaggagctgcttaatcccattaaaatgatgccaatagctgttcctcttttttcacgttctacaagacgagtcgcaacagccattgccactacaatagccgtccccccactgattccttgtaaaattcttgtcatcatcaccatttcaaacgaatggctgacacttgtgatgacattacttaaaataaaaatcatcagcatccatgacagtatttttttgcggtctatattgatggtcagtgcaatgacaatcggtgcgccgatggctgctgagagcgctaaagacgtgaccaataatccagcagcagacgtcgtgacatgtaaatcatttgcgaccatttggataatgcctgtaatgatatattcgattgttccaattaaaaaagctgctaatgcaagtaaataaacaacggttttattcttcatcgtgatgtttctcctttgggcaatgtttacgatttgatttcatctataatcggaatttgaatttcaatgagtctgccttcttcattttcagacagcgggtaataaatctctcggcccggctggtcttctttcacgcggtatccattattttcgatccatgtcgctaggtcaatacaagctgtttgtgcagatggagaatgggaatgaaataatagtgtcgccatagtctcttcagcaggtaacgtacgtatcgtgattccttgaggaagaatgccttttaacgctttgacggaataccctacctcaaattcgaactcactttccttttcgaatgattccctccatagcactacttgtggtcccgagatcgattcttgttgttgtttaagtaataaatgatgaaacgtttgaaagaatgagggaatctcatcaaccgttccgttcgattgaaaagacatgatgcatttgctttcaacagatttgatgatgacctcctgttctttttcaacacatccctctcgttgaatgaggtgcatccgttccttaatacgcgctaatttctgttgttctctctcgatcaattgctgaatctcactttctttcaagagaaacatgccctgaatttgctctactgagatatcttcacgaagaagctgccccatttgctttaacgtaaagcctaattccttatagagaaaaattcgattgacctcaagtaactgctcagctgagtaataacggtatcccgaatcttgatcgatctgctgaggctttaataaatcaatttggtcgtaataccttaaggttttgacaggcactttacttaacatagaaaaatcgccgatcttgaacatcctgcatctcctccgatttgttgatctgatcacagtataaacctttcagttaaggggaaggtcaacatgaagttgattaaatttttcaaaagcacgaaaaaacctagatttctctaacatctaggttttgctcattattctaaaattgttctaacaagcccatctcttccacaatctttatatcattcataaactgttgcaaacttactttgttctcttttttctgtaaatctgaagaataacctaagcatagattaaaaatacaatctaacctttcaccgactccgctaaaataataatttgtcagtactccactatgttcactttcaagaaccacaactgtagccatctctagtacatattcaatatcttctttagaaatcgttcgatcctttttcttagcattgataaattcataactatgaatagagcgtatcctaccttcaagtaaattgagtatagaccttttatagatgacatacacactgtgaatatcacttttatcaggacaatagggatcttgtaaaatgaattttatacgctcatcttctttttccatttttattgcatcaagatcatttaataaaatggaatcaatttcttctattttcataggacgaaaagtgttgactgcatgtgttttacttttcatttgatgaatccaaacaatccaatctttccaggcactttacaatagctccgcttttaaagaaattgaggatgacaccctcgctaaatcgttcggctttcacaacctccatcataagagcaagcacgcactgcgcatttaaatttgagatgtccacgttctccatatcgttcagtcccgattcaatcccattttctttcaggatttctctgtagcggataagctccatctcttcatgttgttctgcaaaggtataaatatctgcaatcaagtgacggaccgtttcggaataattcacaaagggcatctgaatcggatgttcaactgtaccatcattttcttgatcgatgacccattccccaataggatcttcctgaagcagcggtatgtattttgttagaatatcaaattggctcattctcattctcctctatttcattgatatggttcactttgtttctcccgatttcatcaagtattttactagtgagattatttagccacgctggccttcctcaaaccttttatttacctcatactctcatctgctttatgaccaatgctgctgtttcactcggatggctaagaggaaaatgatgaccatatggaacaaagtcaatcttaccaagatgcgatggggcagaatagcctttgtcataagtcccccaaatgatatgaagatgatcctttgtgacctcattgaaatcatcttgattggctttctgttgtagtaagctgttaagctgaaccgtcgtatttaatattctaggagacgtaaaactatttctgactttttcaatataatgttcagggatgctctccgtattttcaaacaaaccagtccttaagacataacgccctatcatattagtcgatgcccatttcaatgtccatttgttcataaattgaggaacatttcgtgatgcagcatttttcttatgaataggcggctgaagtaaagtgattgaatacttctgatcgatgtactcttgtaccaatgcttccagaagaatatatgcaccgaatgaatggccaattagatgtgcaccattcgccgctttctccaataccttttttacgacattcaaatagatatctagaagatgtttctctcgtttaaaaggagaacgtcccaaacctggaagatccaagatccatacaggttgattcgttttttcatgcagttcttgtgctaaagggaataaatcctctccatcactcaacaaaccatgtaataaaataaacggcttcccctctccttgtaattggtaaagggtcgtgttatcacatagtgttcgtttaaataaatgatcatccttaccgtttggattcatcattcgataatccagatcagctactacagcagggaaaaatttcatgacacttgtcttctgaaaccaaccttctcccattatttttttcactgcaacatttgaaaacgttctttttgtcataaagttcaatccatcagaaggaatgtttgtgattttacttacgccactattcatcatagctttcatcaatggtattgggacagatatttttggtgccctcatattcatactttctgacatcacactcaataattcaccaatattctgatcgcgctgccagtcttcaacaagcgtatatgtttgaatagccggttgctccaatttgaaaacctgcacaataaacctagcaaactcatcgtttgaaataagtggcagcctatagtccttacctccaggaatcaccggcatgagccctcttcgcatactcttcacaagcaagcctactcctgctatttgctctgtactccccgtttggctactaccgacgacagttggcggattaatgacagacagcggataacctactgctgatgcctgttgacgaatataaagatctgctaaaaattttgttctctcatatggattttttattttcaaatagctgtttccttctttaaacacatcaatttcaaccttgctattttgatcatcaaagggactcatataaccgacaacatgaataaattgctgcaagcccttcaattgatgaatacttttagctaactcactcatatgtttggcgccatttaaaaagacggaagcggcctctttacttgtcgcttgaatatccatgggtcctcctgcgtgaatgatcacatccgttttcaataccttttccttatcttcagcacttaaacccaattcgacttttgtcaaatcaccttcaacaaagtgcatcactgcctcttttaagatgcctctttcttgaaaagtgcgtgttgctttactttttgaccttactaaaagaagaatgttcacatcctctttggctaattcttttactaactcctttccaataaagcctgttccaccaattaaaaatactgttttcatatgaagtctcctttttagtactattcagtactaatttgatgtaaaaaaaatgcttcttttatcgaagcaagttaaataaatgatctgctgtttttgtgatgacagtggcatccttcaatgtttctgaaataaataatgcgccttcaagattggtaataaatagggatgcaacctcatcaatatgaatcgtctttctgaattccccgttctctactccttgtttcagtaatagagaaaccttcttttgtaatcctgtaaaaaacagtcctattttttctttaatttgcgtagcctgtgtaggactttgaatataaagagtaataaatggacagctccccttatagtctctcgattgaactccttgtgataattgctttaaaaacagttggatacgttcttcaactaaaaattggttctcagataatacatcatcaatggcggattgatacatgtcaatccaataatcaacgaccccttctaataattcctccttattagaaaagtgataatacacattagactttgacactttgcttacacgtactaattcatccatgcttgtataagcaaatcctttttctaaaaataatgttgcagctacttcaagcacacgtttttgattcattaattttacttttttcataattagaactatatagtactaatttaaatatggcaagtgtttatttcatttagaaaaaagtctgatgaaagaaatgccccaaaactaaaaaagctcgaaaatctaatatgattttcgagccttgattaaagtctattttttcacgagagatacaacagtctccacatgactagtatgcgggaacatatcgactggctgcatgtattcgattttgtagtcttttgacatgtattcgaggtcttttgctagtgttgatgggttgcaagagacgtagacaagacgttttggttggacttgtttgacggtgtctaagaaggtgcgctcacagcctgttcttggcgggtccacgacgatgacgtcaggacggaagccttctttgacccattttggcagccaatgttcagctgttcctgtcacataggtcgcgtttttcatgccgtgttttttagcatttttcttggcatcatcaatcgattctttgatgacatccattcctcgtacttctttggcgccatctgaaagccacatcccaatcgtcccaacgccgcaatacgcatcgacaactttttctttgccagtcagctttgccgcttttttcgcttcgtcgtaaagctttagcgtttgcttcggattcaattggaagaaagcacgtgcactcagttcgaaggagacgtctcctaaaaattcttgaatgaccatgttgccagctaggtgagatgtcttatggccaaagatgaccgacgttttttcaccattgatgttgtgcataatggacgtcacttctggcaaacgtttttgaatggcttcggcaatttctcttttctttggaaattcaggttttgatgtgactagaacgacctgtacttcacctgtttcaaaaccgacacgcacaacaattgagcgtacatcgccttttctcgtccgttcattgtagaccgatacaccgaatttctctaaaattttgcggacaacgcccgttgttttgttcgtttttggatgctgcacgatgcattccttgatcggtacaagcttatgagagttcagtccgtaaagccctgcaatgatgtcaccgctatgagaacgccctacttgaaactgacttttatttcggtagtgccatggatcttccataccgatcgtcggcctgatatcaagctgttcaactggtagttttgtatgtcgttccattgattgaatgacaatatctcgtttttcccttagctgctgctcatacgccaaatgctgaagctgacagcctccgcactcttcgtatactgggcatggcggtttcactcgatgctcggaacgctttcttacttttctaaccgtaccttctgcatattttgcttggacattcgttgcttccacaaccacttcttcgcctggaagcgcacctgggacaaagaccacttgctttttaaaatacccgaccccttccccattaatgccaaggcgtttaatggtaagcggaaactgctgtcccttttgcaaaagggcactttgctgtttttccttcacttcattctctccgttctatctgaacccttgataggttgtcttcattttattccatctcattagtataccatgacttggacaaagagagaaaatccctttcatttatctgtctcaatgcttctccataaatataaagatgcgtagcttaaatagggagtccactccttgcttaacactgccatctcttcttttgtcggcttttcaggcaggtcaaaatgacgcttgatggcgttttgaatcccgatatctgccatcggaaagagatttggtcttccaagtccattcatgagcacattttgaactgtccaaggtccaatccctctaattggaagcagacgttcttccacctccagatcagttaattcgtgtaattcttctaagcaaagagagccgctcacaattcgctttgagacatcgatgacatattccgcttttcgctcactaaattggagctttctcaattcctctgtttcaagtgaggcgatggtttctggtaaaggatcaaaccaaaccccctctatttgctcgccgtacgtatgaacaaaccgttttgtgagttcataagcaaacgccagattaagctgctgatgaatgatgcatttcatcaagcaatgatataaatgaaaatccagcatgagaggtgtccccttatgacgctcaaaaacaggtgctagatttgtttgagaaaaatgctcatgcacagcgtctaattgatgctccatgccaaatattcgtttcacctcacagatgagaggtttctcaggaccatttcctttcacccgaaacgtgggcgcttcttttgttccggtggctcgaacgacgacaacgtatggtgtttgttctaatctgatgggtactttgatctctcttttatttaaatcgactgcttttaatggatcatttgataagcgacgcagcacttgatcaaagtgatatggcggttcaacggtcagctctttttcccacatattttcctcttcctttctgcaaacacgcagatgcgattgtttcactttgcatgaatgattctctatattgaatactttctaacataaagagtacaagaatttatcagttatatcttccttatttccggtcattttccttttggatgaaggaacatttttagtcgaattcagctaaaattcgacagcacccttcatgattttaggttcattttccttaaattagaaatagaccctctgggtgatagcttctatcttgaaaatatttgtataattatgacatatcgaggaggtgaacaagggaattagctgattaggcaatcatttgttttatctagcaggaacatattttacctcattgatcaccggcttcacctagtttcactttttacgaaaaggaagacccaaactttttttaaaaaaggagatctgaccaatgaaaaaaaccattctttctattgcccttgccactgctgtttcttcgacactaccagtattcgctgacgctgcggagaaaaaaacgtcagcacccgtctctactacactacagcaaactgtattaaacaaagcggctgaaggaaaagctggaacgacagctagtcctaatgttaacgtcaacttcgatgttcttggaattgccaatgccattgtgaacgcagtaaacgcaaatgccaaccgttctggattcgttaagagcgtgatggaaagcacattctatgctgctggcggcagatataatgtcatggtctttaacctcagccagaactatgaagaccgttttaatggcgtgaaaacttttgctactgctaatcttggcaatgtcgtttatggtatttgggtatttgaaagcggcacctttaaaaacaacggtgatggcggctgggataactgggcgttcagaggctggtttgaccgtcaagataaatttgttacgttccatcgtccttaattctcggttttatccatcaatcatacacgcacattggaccgatctcagtgatgagatcggctttttttatgcagaacacgtataagttcaccggtgctgcttcatgatataatgcaagtctggaggggtgcacatgctgaagaaaattgcagtgacaaaaaacggcgacttgattgaacatgcaacattgcagcagctttcaagccccgatatcgcctggtattggattgattttcatgcgcctacggaaaaggaagccgcgcttttgaaggaatactttcaattccatccgcttgcgattgaagattgcttccattatttacagcggccgaagcttgatttttatgaaggctatttatttttcgtgcttcatgctctgaatcaaaaaacgcttcgatctgaggaaatcgatctgtttgttggtgacaattatattgtgacctttcatttgaaggaagcgccatacattgaccgtgtcattcgaaaactcaaagaatctgataaagcccgaaacagcgggcctgagcatatcgcctacatgttgattgatcagcttgttgatgattatttccctattatttatcaaatagaggacaggctgaatgaaatcgaggatgaagaaggtcataaaacatatggaacattgatgaacgaagtattcgggattcgatccgatttgctcaaactgcgaagaacgattatcccgatgagggaccttttatatcgtattgtcaacacgcatatgatgagaagtgatacgaaccggcaagcatactttaatgatatttatgatcaccttttgaaactaaccgagattgttgaatcaaaccgtgatatgacagccgatttacgagacagctatcagacgctgaattctaatcgaatgaatgcgatcatgatgacattgaccattgtgtcgaccatctttattccactgacctttattgttggggtgtacggaatgaactttgataacatgcctgaattacactggaagtatggctattttggcgtactgattttcatgggtctgctcgtctcgggtatgcttttgtggtttaagcataaaggatggttccacatattcaaataatgtgtagagagaatggctgaggaggcggttagatgaaaaactggattccattgtctcatcaagaacgaaagctcgtatgggagacgctctatcgagatttcaaatttcatccgagtctctctcgtttcccctcatttcgggtaccttctcctttcgttacatatgatatttctgcttattttgaggactcttcccttctacatgctgatgaagaccttgaagagaaagcattacttgtttttcaggagcttatcagaacagacgaatatatgctggcacttgattggcagcacgaatgctactggatcacaccatacggctcatttgaaaaagatgaatttggagaatggacagtgcctgtgcttccgaacggggattattatttctttttatcaaaagagatgcattggggcttgctaggacatccttgggagcaaagtatcacaatttttggtgagggcttgattgattctttctcacgccatcatccgattttgtttcagcgtaaaataagagaaggataaagaaaaagctcgcaggtgttctgcaagctttttttctatagctgagggagatgccatactttttcaagcatgagatcgtctaggcttttaaaggcataaccttgttttttcagtgccgtgatggcatcatccaatgcctcggcattgtcccttgagacggtatgaagtaagtaaatggcacctgggtgcgcctgcttcatcatttgatcgtaagcatactgttttcctttttgatgatggatatgccagtccacaaacgccactgaccaaaaaacggtttgatagccgagctcttttgtttccttcagcactctttcactgaatacaccgcgcggcggacgaagatagaggttgtcttgttttccagtgattttgtacacggcttcattgacacgcccaagctcttctttgatttctttcgtactctttgttgtcagatctggatggtgataggaatggttgccgatgatatgaccttcctctgccatacgtttgacgagctccggctggtccttaacaaagtgtcctgtcacaaagaaagtgcctggtacttgatgttttttcagcacatctaagatcttcggcgtgtacccattttcatagccattgtcaaatgtaaaatagatctctttctttttcgtgtttcctaaatagaaggcatcatacttttttaaaagggcgttcagttctttacccgcatctgccggcttatgttctttgcttttcgcaaatccccaatggacaggctgattagacacggcttccgcttctgagagaggcatagatacaaaaagcgcacataaacagatgagcatgtattttttcatttacgtcacttcccggtttttcttctattgtgcagaataagaccgagactcatacactgattcacctgccaatttaaagaaaaaagcccgcactgtgcgagctattcttccttccaatcatttttaaaccgttcatatttcgcttctaggtcgtcaatcatctggatcagtctgtctatatcctcaacatctgttgattcaggatctaatgaatcaatcacattcataaacatatctaatcggttctttaaataatcaacctgctgctctttgctgtctgctgccttgcccatagatacactccctttagcatttgtttctagcttatctttttttcccttgtaaatcaatgaaaccccacttgcgtataacggtgatggggcttaaaattaactgttggcgggtccacgtttgcccgaatgaaaaggagatagataccatgaaccaaaaaacagcacttcgtccgattacacctgcatatgacccttgggaagcctatctcgatgtgcaggactacggagagatgaagctgacaaatattgaatttacaaccacgacgttgtgtaacatgagatgtgagcactgcgcggtcggctatactttgcagcctaaagacccgaatgcactgccgcttgatttactgcttcgccgtttagatgaagttccgcttctgcgctcaatcagtattacaggcggagagccgatgctttctctcaaatctgtgcgggaatatgtcgtccctttattaaagtatgcccatgaacgcggcgtccgtacacagatcaactcaaacttaacgcttgatttggcgcgatatgaagaaattattccatacttagatgtccttcacatctcacataactggggaactgtcgaagagtttgcaacggtcggttttgcgatgatggatagaaaaccaacttttgaacagcgcgagaaattatttaaccgcatgattgaaaatagccgggcacttgtcaaagcaggtgtgaccgtatctgctgaaaccatgcttaataagcgtacgcttccatatattgaacacatccaccggcaaattgtggaggagatgaaatgccagcgccacgaagttcacccgatgtacccaagtgattttgccagcgcccttgaatcattgacgcttccgcaaatgcgtgatgcgattcatcaactgcttgatattcgtgatcaagacacatggatgctgtttggcaccctgccattttattcttgcagcacagatgaagaagaccagcgcctcctcaaacgattgcgtcaggagaaacatgtcacggtacgaaatgaccctgatggacgctcacggctgaatgtgaatatttttgatgggaatattattgtgacagactttggtgatacaccgccgctaggaaatattgctactgatacattgcaatccgcgtatactcgctggatggacacaaaattagcaaaagagctgaattgtcattgtccaagcgtacaatgccttggtccgaatgttcttgtgaaaaacagctattatcaagatgttgattttacttctcgtacagccagggggtaaccgatagatggacgatacttttctgacagtagtcaagaacaaatacattgaaattctccttgttggactcgtactttggcttgccgtctttttgattaacaaagcgcttcaattgttctttaaacgaacagagtttatagaagacaagaagaaaaaaacgatcgagagcttggtcaaatctgtttcaaaatacaccgcttcgatttgctttgtattgtatgtcatttctctcttctttcatgatttcggaaaaattcttgcaggtgctggtgtggctgggatcgtcatcggttttggcgcccagacgctgattcgcgatattttagcaggcatttttctcatctatgaacgtcaaattcataaaggggattatgtgacagtgaataacctctttaatggaacgattgaagaaattggtctccgatctctgcaaattagggaatggagcggcaagctgttaaccatttctaacggagacatccggcaaatccaaaactataacatgcactacatgcggattacggaatctgtattaattagtgcgaatcaaaacccagacacagcctttcaagcactcgaaacggcctgtgacaatttaaatcaaatgcaccatgattttctcaaaaaagatgaattccagcatgccatcgaaccgtttcaagttcatggcattatgggtctgaacaagctgaaccgcgggattgagatcacagtgaaaggaatggtcgaagacgaaaaatacttcgatgctgccctcgctgtccgaaaagaaatgatcaaacaacttcatcagcatgatgtcaaattgcttgaagatctcgtctatccccagcctgcaaaataacctcatttgtgatggggttatttttttgattgttttttgttaactagttaacaaaaaagaaaggatgttgattcatgacaaaaaaagaggcgctatcatttattaaagagatgtatgaagaggtgttaaccaaattcaatataaaaaaagtgaaggcatatttttcacctgaatatcagcaagagacagatggagaggtttcgagacttgatgagtttaaaaagcatctatccacattaaaaggattgacaaaacagcttgagatccccgcttttcatgatgtgttatttgatgaagaggcgcagcaagggtgttttcgttacacggtacatgtggaactcgcaagcggagacaggggttttattgatgtcatggctcttttcacgttattagatggaaagatcattcgatgcgatgaactgacgcgggctcatgaaaaaaatgaaacgtttgaacagcttggacacatcagctaagaaatctcttcagtcagcccctctaacttctatcctcttgactaattcatgtataatagaaaatagattgatttcatgcagcatggggaccctcatactgtgtattttctaagtgaaagagagtgaataagatgggtcgtaagtggaacaacattaaagaaaagaaagcatcaaaggatgccagtacaagtcgtatttacgcaaaattcgggcgtgaaatctatgtggctgccaaacaaggtgagccaaacccagaatcaaaccaagcacttcgttttgtcctagaacgtgcaaaaacatatagtgtcccaaaacacatcgtggaccgtgccattgaaaaagccaaaggcggtgcggaagagaatttcgatgagctgcgctacgaaggatttggtccaaacggatcaatggtgatcgttgatgccctcaccaataacgtgaaccgcacagcgtcagatgttcgtgcggctttcggaaaaaatggtggaaacatgggcgtaagcggctctgttgcctacatgtttgaccaaacagctgtcatcggtgtcgaaggaaaaaatgaagaagaaacgcttgagcttttaatggaagcagacgttgatgtacgtgacatcatggaagaagatgaaacggtgattgtgtacgctgaaccagatcaattccatcaagtacaagaagcattcaaacaagccggcgtagaagaattcactgtcgctgaaatcacaatgcttcctcaaaatgaagtgacattagatgatgaatctaaagaacaattcgagaaactaatcgatgtattagaagagcttgaagacgtgcagcaggtttatcataatgtagatttaggggaataaaaattgaagccatagtcgtggttgagttcattcaactgctgctacggcttttttattttctgaaagacatgtaatatatagataaaatgttcatttctacaactttccaaggagctgagcttcaactttaaaacatggtggttttcttattatggatttatgatcattcctattattgggctaagttttgttttcagcaactttatgatagtaacaaaaatgattttctttctctacatcgcgtggtatctatatcaaatctttaacttttacataaatgaactgaagagaaaaaaagagaaaccgtattagcaaaaaaaacagtcatctcccctattgataagaggagatgactgttttaattcatcccttgaaacccaaacgtcaggtgatcctgcacaggaatccaagcaccgattccttgtgaggtcacgtttttcacgacgagtttgcgtttatttcctttaagcacaaggtacacttctccgtatgtcacctttcctttttcattaatcgctggtgcataggcatgaagcgatgctgcttttttcggagagacgtggtatgactgatctcgctttgttcctgcgccaatcacggtgtcaaaagcgaggggcagctttgtcttttgaatggctttttgcatcatcaatgtttttacatcttctgggcttggcacctttgctgtgagcccgccgctcacttttacttgctgcttttgaacgtacttgccaatggctgttttggtgccgcctctgttatcaatgtgatttgtattcacttttttgtattcccagttggccaccgtttcgtttgaatcgtagctcagtgcccatcttccaaggaaaatggtcgcacggtaaccaacagctaatggcgtccctgaaatactggattcattcagcattttgatcaaatgggtattctcaatcggcacatctgttgttttaaacaattcggctgtcagctcgctcggctggagcaatggctgatcctgtgacgcattcggatacgtattctccttagaaatactagcgacagacgatggcaccttaaatggtttcgccgcctccgctggaaaactgtatagaaaacttaaggataagagaacaacaaacatgatgcggggcatctttttcatatcatcactctttctcattcatttttccatagtattttccgcaaagtcgtcccttatccacaaaagattataaaaggaaaaatccaatcgccataatgaaataggcagcaagtaatgtggcgccttcaaaccaattggtatctccgtcattagataaaatgactgtgagtaatacagcggacgccatggcaatgagctctggtaaggagaaaatgagcggcatttgcgtattgaaaaaaagcgagctgatgacaaggattggtgccaccatcatcgccacctgaagcgtggaaccaaaagcgatttccactgcgacatccattttgtttttatacgccatgataacagcagaggcatgttctgcggcattgccgacgatggccacaataatgactccgataaacagctcactccagccaaattgcttccctaccgtatcaaatgtatggacgaggcgctctgaaatgtacgcaacggccatcgttgcaagcagcaaaatcaaagtcgcaaactttccagaccattcaggtgtttcttcttccgtctctgcttcgccttccatgctctcctgcttagcaacatacaccccgcggtggctgaccagtttgaaatagagcgccgcgacataaagcaaaatcatgacaatactgatcccaatgcttaaaacaaactgtttattctctgccatctccaccgaaaacacttctggaatgacaaacgccacaataatggcaaacatgagcaagcctgagttgtgccttgcatcgtggacattgaacacttggcgcttatattttaaaccgccaacgaaaaaagacagccccgccacaagcagtaagtttccgatcactgatccagttaatgatgcaaggacgatggctgtcagtccttgctttaatgcaaaaaacgaaataattaactccaccgcatttccaaatgtggcgtttaaaagcccgccaattctggggcccgctatgatggcaagactttctgtggctcttcccataaaactagcaagaccaataatcgcgatacaatacacagcaaacatgataacctgcggaaaatgaagaaaactgccaatcaccgatagcggtacaccaattgcgacaatcacaagaaacaaacgattcatacagccattctcctttacatatgtctgactgttattctttcgtgagtgccggcatcatatacatgttagatttgcgcgtgtgagaaggtgatatcaatacttcctttcacggactgcaccatagagcaatgcttcaatgcaagggtgatcactttatcgatttgttcatcagatgtattaatgtcttcaaataagatatgtaaatgaatgctggaaatcttgtttacagctcctgcccttgtcgtttcaggtgtgatcgtcagcccttcacaagatattcgctttttccggcaaacatgaatgagcatttctccaaaacagccagcaatagctgaggtgaataattgagatggcctgtaccccgtttttacattgcctgatatatgcagctgcccttcatctattctcgcgatccatcgatccgtttcgtatctcagtttcattccttttccacctttctattgaaacccctatggttccattgtacgatgaaaatatgaacttgtaaggagcttcttatgtcgagaattcactttatgattttaattttacttgtatctgtatcaggtttttcgcagggagcgttactgcctgtcatttcgattatttttgaacatgccgggacttctcctacgttaaacggactgcatgccacaggcttatatctcggtgtactgcttgcgtctccttttatggaagcaccgcttcgaaggtttggatttaagccgttaatcgtgattggcggcgctgctgtctttttaagcttgttcagctttgttttttttgaatcttatgttgtctggttcttcctgcggcttatgatcgggattggtgaccatatgctgcatttctctacacagacttgggtgacctatgcgtcgtcatcgagaaaccgcgggcgaaatatttcattgtatgggttatcttttggacttggttttgccgctggaccttttttaacaccactcattgaaatcaatccatctttacctttcattgtttctggtgctgttagcttatgtatttggctgcttgtttttgttttgaaaaatacatatccagatagtggcgaagtgcagacgtcagagcagacaaacagtttgaagcgctttaagaaagcctttcaatttggctgggtcgcctttatgatgccgttttgctatggatttttagaaacgacgcttaatagtaacttccctgtatatgcgctaagaagcggggtgacagtagatgcggttgcgtttattttacctgcgtttgccattgggagcattgtctttcagcttcctcttgggatgctcagcgaccggtttggcagacgccgcatcattttatgtgtcacactcgttggatctttctttttcctactagcaggaatattcattcaatccgttttggctgttgcgatttgtttctttattgccggaatggctgtaggctctaccttctcacttggcatcagctatatgaccgacttattgccaaagcatctgctgcctgctggaaatttgatgtgcgggatggcgtttagtgcgggaagtattctcggtcctgttctcggtggaatctttgtgcaaacgtttgaaggtatgaatttactttaccttgtcagcatcgtgatattattcgtgtttttctgcgttcgattcggacggacggcggcagttcttgaaaactccaatgaagccatttctaaataaaaactcctctgcacccatgcagaggagttttttttcatttaatgatatccattttgtccgttcgcactgccgcttgttttgttcttaggttgatggcctttgttttgttttgtattgcttccgccttttttcgattgtttggacatatgtgatttcccccatccattcagtttgaacttgatcgttcttctgtaggatgcccggatttcattatagtttgcctggtacgattttacgcttatgtaaaagcgcattgagctcgccgccaaggataatcatgatgccggttaaataaaaccagatcattaaaataatgattcccccaatacttccgtacatcgcactgtagttggcaaactcgcctacgtaaaatgaaaatagcatgctgaccaaaatccatccaatcgatgcaaaaatggcacctggcagaacaaattttaatttcagcctgatgtttggagcaaaatagtataaggatgtaaaaacaatcaataaaatgagcgggctaatgatccatctcatcgcagtccatacagtgagaaaggcatctgacttcccaactaatttagcgacgaataaaccaagttctttgccaaagacaggcagcatcagggcaaaaataatggtcaaaaccatcgcaatcgttaaaatgatcgatgttaaacgtacgagaatgaaggaacgattctcctcaacttcgtaagcatggttaaatgctctaacgacggcattaatgccgttagatgctgaccaaagcgcggcaataatcccgaacgacaataacccgccgttccgattattcagcgtctgttcggcgatggattcaatcatcgaaagcgctccttctggcgcatagccagaaatgacgctcaggacatcctttgacgtcagcggcaaatacccaacgagtgtcagtacgaagatgagaaacggaaataatgaaagcaaaaagaaataggcaagctcagcagattttgccggtccttcatgcagcaaaaagcgttcaattaacgctttaataaaacccatacgcctcatctccaatgatcaatctgtctgtttcgattgaaagtgatcctttgtttcttcaataatttctaatacccttggtgttgtttcctttaactgattgacctgttcatttaaaaatgacaaatcatctgagactgttcgcatcagttgcttcgtttcttccatcttttctttcatgcaagctgatattctgcctggctcttggcagacctcttccagcttttgctggcagtcattccatttgtctttgagtgcaattcttgttggtcgatgaaataaagtcagcaatgcgccgcaagcggcacctaagagagctcctcggagcacgatttgatttttttcttccatctcgtctgatctcctttcagttaaaggtggttctctttctttacatacgtcaaaaaacggtcaattcctgtttcaattaattcatggacttcctcaaagttcccagtgtaataaggatctggcacatcatctcgatcgtcgtcttctacaaaatcaagaagacggccaataaagtgatgtttcccatagccggctatactgcgcagtgcccctacattttcagcatccatcgcaatgatatagtcgtatgttgtgatgtcttcatccatgatttgtcttgcggacattccttcatagctgatgcctttttcatcaagcagctttcgcgttccttcatgcgggggactgccttgatgccatccgccaatacctgctgaatcaatcacaaagtgctcgctaagcccctcatcttctactttttttctaaacatggcctctgccatcggtgacctgcaaatattgccaagacacacgaacaacacatgaatcatccttcattctcctcctatcttttccctaagagttcttttcgaaaaccttttctctatcatatcaactcccttttcttttggaaactttgcaagaaaagctctcatcgccattgacaaaatacacaaaaacaggagaaactttaggagaattacacaaacaaagggggatattagatgggaataattgagcagtttgtcacaacgatgaacaattttttgtgggggcctcccctgttgattttaattgttggtactggaatatacctcacctttcgcgttctcttcattcaaattagattacttccttattctttaaagctcgctttttcaaaacaagacaaaatgtcagaaggagatatttcccatttccaagcattaatgacggctctcgctgcaactgtcggtacaggaaatatcgtaggtgtggcctcggctgttattgcgggtggtcctggtgcagtattctggatgtggtttgctgcatttttcgggatggccaccaaatttgccgaagctgttcttgctgtgaaatacagggtcaaaaacgaaaaaggcgaaatgtctggcggacctatgtattatttagagcacgggttaaaacagaaatggctaggggtgctatttgctgttttcggtgccagtgctgcctttgggatcggcaacctagtacagtctaattccatctcaggcgttatgaattctacttttcaaattccaacatgggtaacaggtatcattattacagcttttacagcacttgtgattttaggcggaattaaaagcattggacgggtcacatctatttttgtaccggtcatggctttattttacgtcatttgcggtctgatcattcttgttatgaatgctgatcttgttccaggcgcagtcggtcttattttctcagatgcctttaccggtcaagccgtggcaggtggtgcaattgggactgtcattcgctggggtgtggcacgaggagtattttccaatgaagcaggtcttgggtcagcaccaattgctgctgcggctgcgaaaacggatatgcctgcccgtcaagctctcgtctctatgacgcaagtgtttattgatacaatcattgtttgttctatcactggcattaccattgtcatggcagatatgtatttaacagtgaaaagtgatgcgctgacctcgttatcctttgctcacttcctcggtccagctggctcaaccattgtggcaatcgggctgctcttgtttgcctattccaccatcattggctggtcctattatggcgaaaaatgctttacatatttggcgaaggattcgtacgtcatgtattatcgtatcgtgtttgtgatggctgtcttttttggtgccgtgtttaaaaatgacttcgtctggggtgtggcagatatgctaaatggactgatggcgattccaaacttaatcgggctcatcggtttatcaggggttgttgtatttgaatccaaacgaatcattgttaagattaagcaggagaaaaaggagaaaaacatctctgtgtcatcttaatagcccttttattcttttgcatttctgttaaaatagacatattattcgacacatatgcaggaaaggacgtgccgcccttgtcagagcaaaaagcggctgaagtcaatcagctgattgaagacatttcgcaaaagttaaatatgctgaacattggagtcatcaaagcagaggacttcagtccagacaagtacgaagatattgaatttcttcaccaaatggtgatgaaaaaatcttcattcagcccaagtgaaatgcaagccatcgcaagcgagctaaaaaacttaagaaaataatggtgaaaaaggaaactgtttttatggtctacacgctgttttcttacatcatgcacacaaaaagccagcaccccgcaaggtgctggctttacaactgcggttttatttctcaagcagttttaatgattcacggttaaaggctggaatgtcatcaggtgtacggcttgtcacaagctgatcctgacaaacgacgacttcttcgtctttaaatttagcgcctgcgttttccatatcgactttgatggatgtatagccagtcgcgcctcttccttcaagcgtcttcgctgtaatgagcaattgcggtccgtgacagattgcaaatactggttttttctcatccataaatgctttagtgaattggacgtaacgatcatctgcacgtagaatatctggtgagaaaccgccaggaatgagaagtgcatcgaagtcttcaggcttcacgttgtcaatagacgcatccactcttacttctgcctctccttgcttccctttcactgtttttcctttttcattttcaatgactgtcaactcatgacctgcatctttaaaggcttttgcaggctcggtgaattcaacatcctcaaagtaatctgttaatacaactgcaattttcttacccatgtagaaaccctcctgcttgattatcgtttacactacacactatacccgggcatgttgaaatcaaacatcctatccctatcagaaaaccccttatgataaaaatgaacatttagactcattcacattcccttaacaaggtaattcgtatgatttgtgttatctttacaataatcttcaaaaaataactacaaaagttaacgaaacatttctacaataggtattgtggtcaaaaaaattagaaaggcggagatcaggtgaagaagcaagcacataggtctaaacgaaggaaaaacctgtctattctgctcacttccattatgatgattagtctcattctcccagcagtacctactcatgcagaaacagaaaacggcaaagccgtaaaggtcagtatcttagccacaaccgatgttcatgcgaacatgatgaattatgattattacagcgacaaagagacaaatgaatttggtttggcaaaaacagccgagctcattgacaagcaccgctcacaaaacccaaatacactccttgttgataacggagacctgattcaaggaacccctcttggagaatacgtttacaaaaatgagaaagacagcatcatcaatcaaacaaaggttcaccctattattcatacactcaacaaactaaaatacgatgcaggaacacttggcaatcatgaatttaactacggattatccttccttgacggtaccattgcgggcgccaatttcccgattgttaatgcgaacgtcaaaaagctaaatggagaacaccgttttacaccttatgtgatccaagataaaacctttaaagatgcaagcggagcctcacaaactgtgaaagttggttacataggattcgttccaccacaaattatgacgtgggataagaagcatttagatggacaagtccaagtgcaggacatcgtcgaatctgccaatgaaaccattcctgaaatgaaagagaaaggcgcagatgtcattgtcgctcttgctcatacaggaattgaaaaaaacgcttcacctaaaggatcagaaaatatgatctttgaccttgctacgaaaacaaaaggcatcgatgccattgtatcaggccaccagcatggcacattcccaagcgctgaatataacggcgtcgacaaattcaatgtctcaaaaggaaccatcaacggcatcccagtcgtcatgtcaaaaaactggggcagctacctcggagtcattgatttaacactagagcctgatggaggcaactggaaggtcacagacggaacaggcaagatcgaatctgttgccggagtatcatctcaaaacagcaccgtaaaagatgccattcaaacaacgcatcaaaacacacttgattacgtgagaaagcctgttggcaaaacagaagcagacattaacagctttttcgctcaagtgatggatgacccttcaatacaaattgtgacagatgcccaaaaatggtatgcacaagaaaaaatgaaggacacgtcatacaaaaacttaccgattttatctgcaggcgctccgtttaaagccggcggccgaaacggtgtgaattattatacgaatatcgcaaaaggagatttagcgattaagaacatcggcgatctctacctttacgataacactgtgcagattgtgaaactgaaaggcagtgaagtgaaagactggttagaaatgtctgccggccagtttaatcagatcaaaccgaacgatgcaaaggaacagccgattttaaacgaggaataccgctcgtataactttgatgtgattgatggcgtgacataccaagtcgatgtgacgcagcctgctaaatacagcacaacaggcacacttcttaacaccaatgccaaccgcattaaaaacctgtcttacaacgggaaacccgtctctgacaatcaagaatttttagtcgtaacaaataactatcgtgcttctggcggcggaggattccctcatttgacgcaagataaagtagtgcttgcctcagcagatgagaaccgccaagtactgatggattatattatcgaacaaaaaacgatcaacccaagtgcagatcaaaactggtcgattgcaccgatcaaaggcgcaaccgtcacttttgaatcttctcttttagccaaaccgtttgctgagaaatcaagcagcgtagactttattcgtaacgcaagcacagatggtcttggtgtatacaagctagcctttaaagacgatggcacaacagaaccgccttcatcagataactggaatttaacagtgatgcatacgaacgatacacacgcacaccttgatgatgcggcaagacgcgcaacaaagatcaaagaaatccgtgctgaaaataagaacaatattctattagacgctggagatgtcttctctggtgacctgtacttcacaaagtggcaaggacttgccgatctaaaattgatgaacttaatgaaatacgatgccatgacgtttggtaatcatgaatttgacaaaggtccttctgtactccgtcaattcctgacaggtgatgcatcagatgtcgatccgaaaaaccgtcatcaatttgaaaagcctcgattcccggtcgtgtcatcaaacgtggatgtctcgaaggaaaaacaattgagtgacttaatgaaaaaaccagcctcatttaaagctggtgagaaaaaagaagccggaatttacccttacatcctgctcgatgtaaacggtgaaaaggtcgccgtattcggtttaacgactgaagacacagccattacatctagcagcggtcctaacattcaatttaaagatgcgtacaagaaagcaaaagaaacagtcaacaccattcaaacaaaagaaaaaattaataaaatcattgcgttaacacacattggctacaaccgtgatcttgagctcgctcaaaaagtagacggaattgatttaatcattggcggtcacacacacacccttgtcgaaaaattaaaggttatcaagaaaaaagaacctacgatcgtcgctcaagtcaaagattacggacaatttttaggaaaagtagacgtggcctttgacaaaaaaggtgtcgtccagccaaaagaatcttcttttgacctaatcccaattgatgactctgtcaaagaagatgcagaggcaaaagcgatccttgatggatacaaagcagaaattcaagatttaaaaacagaaaaagtcggccatacagatgtccttttagatggccagcgtgagcatgtccgtgcgaaggaaacgaatcttgggaactttattgctgacggcatgctgcagaaagcgcaagaatctgctggagctgaccttgccatcacaaacggcggcggtattcgtggaagcatcgaaaaaggtgatatcactttaggtgatattttaacggtgatgcctttcggaaataccctttatgtcgcagatttaaaaggcagtcaaattaaaaaagcactcgaacagggcctgtcaggcattgaggaaggcggaggcgcattccctcatgtagctggcattgaatatacgtttacactcagtaaaccagctggcagcagactgattgatgtgaaactgaaagaccaaaagggtcaactgacagacattgatgatgagaaaacataccgcgtagctacaaacgcatttgtcggcacaggcggcgacggctacagcgtctttacagaagcctctcatggtgaagatttagggtatgtcgactatgaaatcttcaaagagcaaatcgagaaggcagatgggaagatttcgcctgtcatcgatcacagggtgaaagaagtgttccttcctcgcgtgaaaggaaaaggcgcttatgacattcaagatgatgagaaattccaaacgtatgtgcagcatacaaacaaagcattgctatatttagacaaagcaagcaaagcgaaaaacgttcaattgtctctatcaaaagcacaagtagccgagctgaagaaaagagagcaagatccaaacgtcaccatctatcatgacaaagtgggactcgcattacctctctcaaatttgtccgagaaaaacgcagatatatggatgacaaaaacggataaagtgaaaaacgcattaacggatacgtatgatttccaaatcaaacaagacaagaaaaaggtttcgacctttaaagacccggtcacactatcctttacactagacgagccgcaaaaagcgaaaaaacctagtgtgtattatgtggatcgcaagaaaaatcgttacaccaaaacaagtaatggatcatttgaaaacggagtcgtatcaggtcaaactgagcacttcagcgaatataccgtcctcaaccaaagcgaggcagctggaacaaccccagatcaaactggcggagacggcggaacaacagcaccaggcggaggcacagatccaaaccaagatggaaccggcctcccaggcggcacactgccgaatacagccacaatgatgtatacagctgtattgattggtgtactcatgcttgcctcaggaggtatcctatattactaccagcgcaagcgtacaagaaaaaatgtttcatcctaaaagaaaaggacagagccgcctatgctctgtccttttttcatctcaatcttgggataaataaatccaattgcgcttatcaaattctttcacatcatctgaccctatatgacgcagcattctattaaagaacgtgatgtcatcttcatcatcgacggcatataaatcctcttgaacataatctcttatcataacattcgttaagttcgtatgattcacaaagtctgcaaaataatcttctacaagagttaaatcctcttcacttaatttttcatcattgataatggaaatatgaaaaacattcaaatacgcttgtatatcttcttcatccatataacataaaggttccagctttctgtcttctgccgtaaacggttttcgcgtatcttcaatgatgacataacataaaatctgctgatctttcatcacgctgaatatttctaaatctcttaattttaatgatctatttaatctcatcatctttcctcctgaaagtagtgatctattcgtcatctacttttcccaaaacccgaaaaggacagagcctatgctctgtccaatttttctcttctagcaaaatcgacgaatctgaagcggtctaatcggtgacggctttcagtgtattgaaataaacttgtatcctctaagaacacgtaattcttcacgacgacgacatggtcaaacccgttcaaatcaagatacttggcgtcctcttctgtacatggctctaccacaaactccttttgggcatagctgattgatacaccgagctctccttcaatatactcgtagatggatccttcgcatatgtctttcgacaagactgacacatgcttttgcaaaaagtaatccttgtctaaaatcacttcttctccgctaatattacgagatcgaatgacttcccagacatcctcctgcccactaattttcagctgagactgaatatactgatccggtttgattaaaccaaattcgtgaaccgtcgtaacggtctttcggccaagcgtttgggaaagttctttaaagctgacaagacctgagactgggaattgcattttctctcgattcagcaagacagagcctttgccgcggattttttggatatagccattttgcacaaggatatttaatgcctttcttaccgtctcacgggatgtgtcatacatcaaggacagctcatgctctgatggcagaatgcctttatcctgccattcaccttgttcaattcgttttgcgagctgatcataaatcactcgaaacttattctctttcattttccctccgccccattttctagcgtttggttaaatgataaacgattgactcatatggacgcaacgtaaatcccttcatatctgccggcacatcctcataattggataacagcacttgcccttccatctcatctacagcctgcacaagctcatcaggaagcgtaaaatccgtctctcctgcgtaaaagtgattgatcacaagaagcttctcctcaccgctttctctcacataagcaaaaaccttcgggtcatctgctaagagtaaggtgaagcttccatatgtgatcacgtcaagttctttacgcatcttgcaaagggcttgatagtggtagaaaatagacgtcttgtcttttaatgaagcttcgaccgaaatgtcgttattggctggctcaatccatggtgttccttttgagaaaccagcgttcttttctgaggtccactgcatcggtgttctcgcattatctcttgatttgacctgtaaaatggcgagcgcttcttcctttgatttccctttttcaagcatggcttcatacatattgagtgattcaatatcgcggtaagacgagatgtcctcaaactgaggattcttcatgccaatctcttccccttgataaatatatggcgtcccttgcatgagatgaatggtggtcgccagcatcttcgctgattgctgatggtacgtttcatcatcaccgtatcttgagacgatacgcggctgatcatgattgcaccagaagagcgcattccagccgccgccctcatgcattttcgtctgccactcacatagaatcgacttcaattcctgaaaatcaaatggtgcgagtgcccatttttctccgtttggataatcgacctttaaatgatggaaattaaacgtcatatccagctcctgccgatccggtcttgtataccgaatacagtctgcgatattcgttgaagacatttctccaactgtcatgctgtcatatttcgaaaaaacctcttggttcatttcgtgcagaaactcatgaatgcttgggccatccgtataatacattcggccgtctccttgtacagattgtccggcgtcatctaagaagcgttgatcctttgagatgttgttgatgacatccagcctgaatccatcaattcctttttcaaaccaaaaatgcatgatgtcgtatacttgcctgcgaacctcatccttctcccaattaagatccgcttgggtgacatcgtataaatgaagataatactctcctgtttcttcatctagctcccatgctggaccgccaaattttgactgccaatcatttggcggagatccgtccactttaggctccttccaaatataataatctcgataaggattatcctttgactcgcgagatgcttgaaaccactcatggaaaatggatgtatgattgacggctaaatccatgatgactcgtatgcctcgatcatgggcttctttcagcatgtgttcaaaatctgccattgtgccgtacatgtcatggatttttgtataatcactaatatcatagccgttgtcatgctgcggggactcatacattggcgtgagccaaatacaatccgccccaagctgtttgatataatcgagcttttttgtcaccccattgatatcgcctgtacctgagcccgttgtatctaaaaagctcttcggataaatttggtaaaccaccgcttttttccaccacggttcgtttgtttgttgtttcaatttcatccaccaccactagttaagttcttgtgaaacatctttcttcttttttagctttgcatacaaaagggttccgatgaatgggacgatgagaacaatgaccatccctatcgcaaatgcgccccaatatttcgggataatagagaagattcctggaatgcctccaacaccaactgagcttgccagcaccccttgagaggcgataaacataccagctaaaccagagctaatgagtgcgaaaataaatgggaatcggtagcgcaagttgacgccaaacatcgctggctcggtaattcctaagtaagcggaaatacttgatgtgagcgagagacccttttgcttttcatctttcaatacaaacatcatcgcaagtgcggctgatccttgtgcaatattagacagtgcgagcatcggccatagaaacgtgccatgcagttttgaattaattaattgaatatcaacagcgaggaacgtatgatgcattcctgtaatgactaacgccgcatacaaaccgccatataatagaccgcctagtgctgcgaactgctggaatacagcgacaagtccagatgttaacacgttaccgattgcaaatgtaataggtccgatgacgataaaggataaaaagccaatgactaataacgtaatcggtgcaaccactaatagctggatgctttcaggtgtccgttttgtgataaacaattcgagcttcgctaataaatacgaggcaacgagtatcggaaggacctgtccttgatatcctaccttttgcacttcgagtccaaacaaattccagacaggaatctcaccggacttttcagccgctccatagccccacgcatttaataaatctgggtgtacgagcatgagtccaaggaccatccctaaaagcggatttcccccaaaccgcttcacggctgaccagccgattaatgcgggcaggaatgtgaaggcagtgcctgcaatcaagttgatcatattcgctaaatctgcccatgccggatacacatctacaatcgatttttgatcaaagaaaatatcaggagctgttaaaatattattaatccccattaataaaccggcggtgacgatggcaggaagaatcggaataaaaatatccgcaagcgttttcacagcacgctgcaatggatttaatttttgatcagaggcacgcttcacgtcctcttttgtggcttccccaatccctgtctgtttcaccatttcggcatatacccgattgacgaccccttggccgatcaccacttggtattgaccgttcgctgagaaagatcccttcacttcttctatttgttcaagtgctttctcatcaacctttccttcatccttcagaacaaagcgcagccttgtcacacaatgtgtcgcttgatcaatattttctttgccgccgatggctttcacaatctgatctgctgctgcctggtaatcagccatgctatcccctccgagatcgttttttataagaaaaaagaaccaaaaaacttgtatatacatgtttgattcttattttatatttgtatatacatgtagtcaacaacaaaatgtagcgctttcatataaaaagccccctcaatgtgctcaggagaggcttcgtgtcatcatctttttttatgctccgttaatttttcgtagaccctgtttttataaaaggaggaggctggacgggcaaaagtttggcgcttagatgtgagttcatccagtcgtttttgtttttcttcacatatgagagaaagcttttttctttcctctccgtctatactggagtgaagcagctctttgacggtcatgagttcttttttcaatgctgtttcttccccagcaaagccagcatttttcatcatccggtagcccattcttagttcttcaggcacatgagcagcgtcatctttaggcagaggtttgccaaagccagataaaccatcaaaagccccgttatccatcgcttttttaatccgttcttctgataatctctgtgcaaaatccatggcgttctcctttcgtctgaaacgatttgattaagcatagcaaaaaagctgactctctcacaagagtcagcttcagctacactgaacataaaacaaagggctaaaatcaaaatcattttagccctttctcgttatttattgtcgattttgaaagtagaaaccatctgtgctaagtcctctgacatatcagatagctgttcaatcgcacttgaaatttgctgcattccagcactttgctgttctgttgctgccgctacttcttgagagctagctgcatgttcttccgatacaacagaaatttgctcaatcgatgtagaaatcgtttgatatgcttgctcaacttgcttaatagaagcaagcaaattgttcgttcttcttgaaaactgagacacaccgtcgtaaatcaatgcgaagttttgtgacgtgccttccatttgctcacgtccttcttccactgctttactgctttcctctacgctttcaagaacgcgctgactgttttcctgtgtaccaatgacgaggtctgaaacggttttagccgcatccgctgattgctcagctaacttgcgcacctcatctgccacaacagcaaacccttttccttcttctccaacacgtgccgcttcaattgaagcattcagtgcaagcagattcgtttgggctgaaatgtccgtaataatcgagatgacactttcaatctccgttgaatgagattgtaattcttctgctgcctgctttgagttggtcatcttatcatgtagcatattcagatgatcaagcacatggttgactaatttttgaccagattctgattgctcttgtacgtcagatgaaacagatttcatttcatcaacttctttggtgacgccttcgatttgagtatcgatctcagcaacggatgtcgtacaatccgtaatatttgcaacagaatcattgattccttcactcatattcgtcatagcttctgatacttgctgcgcactttgactcgattcggtcgtcactgtacgaagctgtgaagacattttcgacacttcactagatgagtttgagattttcgaaatgagctctttaatccgtccctgcatcttttggaaggatgcggcaagctggccgatctcgtctttactttcaacctctaccataccagttaaatcaccgtcagcaattcggttcgctgattccatcaatgaacgtgctggtttcgcaattcttcttcccataaagaatgagaagagtaaaccaccgatgagcacaatggcagatgccactgtaatatagatcgtcagcttcttcgttgtttcaggcacgacagatgcatctaaatcaatccctaaaatccctgtcagctcaccgcctgaatcctttattggcaaaaagactgatttatgtgttccaaatgagtctttgtaaatatcacttttgaccattttatcttcagagagcgcttgtttcatctcatctgaaaagacataatcttgatcaaaatcattttcttctccggttaagataattattctttctttgccgcctttattagaaagcacatataagttctcaagcgtatgatcttcttgaagctctgtgaatttctttttgacctccacatataggggatcatctttcccgctaacaccaaggacgtttccatccacattatcaatctctttcttcgctgtatcaatatctgttgttaatcgataatcaaattgctttaataactgggatgataaatcctgacttactagataaaatgttagaacgaatagtgcaacggttgctagtaatgttacgacaacgactgacatgattttagaggatatcgtgtatcctccaaatttcctttgtttcgccattttttcctacatctccactctcagatttgatttaagcatgtacatgttcaaattgtccacaaacagatgcgatcacatcttttaaataagatacgatatgtgggatatgctctggtaacgtataaggtgagatgacaaaaaacttactaacacttagatagaattcttgtccttcttttgcatttacaagtaaaaacttcgttgtatccccaaagaacatttcgtctcgtttctctccaagcttttcaaacagcattttgttcaattcattgttccgctcaatttccattgccgtcgcttcgcctgaaatttcttcttgaaagcgcggtgagccatctaggtaaattctaaataatgtagccattccgacgttgtcatcattcacgacttctgcttgcggaatttcttgactgagtgcttctctgaaggcaaggttcacctctaagaattgaccaagcaagcgctggtagccttcaatcccaaacgttaacagcacactcagcatactaattgagcttcccattcttgagcattccagtgtataacccgtatggtattcgccgtagcctctatgaccaacgtatggtgtctcttgttcttccagatctaaacgctttaggtctgctgcgtttttcactaagaataaactagatgtgtaaggcgtttggccgagcttttgaaagtcaaagcacatcgtgtcagcaagagaaagatgctggaatttcgctttgatttcttttagcatacgaagaacaccgtctgtgaattgcagcgggttttcagctagatcatactcattaaagaaagcaaagaatccgccgagcgctgaatctgcatgaatatgcggcacctttagaccatactcctcagcaatggcttctgctgtttcacgtaccccttttacatcatcaattgcaatggcatctgttgttccggttgttgcgacaatataaacgggaattccgccattttgtgcaacacgttccatttgacaacgcaaatcttccatatccatcgaatgatctttattcgtcttaattctgatcaagttgtctgtgcctagtcctgttgcttccattgacttaaataagctgtaatgtgccgcatcagaacaaaacgcataaaggttttgcggaactccttttcgtagtgactccggcgcaacttttgcaatcgctaaacgcagtcctgagaaaatggctccttgacctccccatgttgtatatcccccgctcacacttggatcatatccgatgagcttagacatcattgagaccactctgacctcagcttccgctcctgctggtccatacacatcccataggttgtttccatttaccagcatcgccgttagcatgcctagaattcctggtgtacttgccatcggcaaaatgttcgtgaagaaatactttgtgtggtaaggatggttatgtaaaagcttcagtaattcttcattcacaagttccgcttgttggccgttcaccggaatttgacttgtttcagtgagcttttgataaaaatcctcctcgcgattcttttcaccctttaggtgtgcacggttcggatctttcaggtgatcgacccctgaaactatctgctccatcaatttgatgagttctttacgctctgctgcatttccgtcctcactcggaaaccagttctgaacgaggttgtttgctcgtacagtcatatactatcaatcctttcaatggaagatttcctgtcaaagtctatatcgaccccatttcaaaagtttatagtctcgaaatgttcacttaagtatatttagataatttgttcattcatcaaaataaataaaacccttacaaaacacatcaaaaccattatgtcgatgaaacaaaaaaatatattgatatatctcatagcaggaaatttcatccacacctttcctccgtttttcttctcattttttttacttaacctgcataaacattacgaaacactggaaatactctctaaatcatcattgtagaaactaaattaattctttagactcgtgcctttttacctgttttattgatatagcaactgggaaattgctgaattttctgttaataataggatgaatttcataaaaagtttttcgaagatcgaatattttcgttctctccccttttatggcgcggacgagctgctagacactcttcgccggttatcacttttctatttgatcatttcatggtatattctaatggttcgttttctttcgttccgcctcttccgtgtatcggagaaaaggagtgtttttatgaaaacatttattcaaaaacgaggcctcggcttctttgttattgcagccatcttactttggctcaaaacgtattcagcctatttaattgaatttaaacttggtatatcaaatgtgcttcagcatattttgcttttcgtgaatcctattagctccagcttgttctttcttggctttgctttattgttcaagaaaaaatggcagcctgccgctatcattgtgattcattttttcatgtcttttttactatacgcaaacatcgtgtactatcgattcttcaatgactttatcacgctgcctaccgtgatgcaggcaggaacgaatggcggacaattaggtgatagtgcattttcactcatgcgttggactgatatgttttactttatggataccatcattttgatcgtactcgcagtccgcatgaaaaagcagcaaacaagtacagctactgtacctgttcaaaagtcaaaatcgtttagactcgtccttgtgtcctctgttgtcatctttgtgatgaatttagtcgctgcagagattgatcgtccagagcttttatcaagatcgtttgaccgcaattatttagtgaaatatttaggtgcttataactttactgtgtttgatgccattcaaaatgtgaaatcaaacagccagcgtgctctggcaaattcaagtgacgtgacagatgtagagaactatttaaaagcgaacagcgctgatcctaacccggcttattacgggaaagcgaaaggcatgaacgtgattacgatttctcttgaatctctgcaaaactttgtcattgattacaaagtaaacggaaaagaagtgacgcctttccttaattcaatggcacacgacaacaaaacgttttactttgataacttcttccatcaaacaggacaaggaaagacgtctgatgctgaatttatgatggatactgggttattcccattatcacaaggctctgtttttattaacaaagcgcaaaacacgtatcaagccattcctggcatcctgaagaaggatcagtacacgtcagcagaattccacggcaatacgaaaaccttctggaaccgtaatgaaatgtttaagtcatttggatatgacagattttacgattctgagtactacgatatgaatgagcaagatacgaagaactatgggctgaaagacaaaccattcttcaaagaatctatgccaatgcttgaaaacttaaagcagccgttttattcgaaattcattacgttatcgaaccatttcccatttggaatggatgaaggggataccgatttcgaacctggcgacttcggagactctgtcgtcgacaactatttccaatcggctcattatttagatgaagccatcgaacagttcttcaacgacctgaaaaaatctggtctctatgacaatacagtcgtcattatgtacggagaccattacggcatttctgaaaaccacaatgaagcgatggaaaaagtgacaggacaaaaaatcggggattatgaaaatgcgcagctcatgcgtgtaccgctatttattcatgtaccaggagtaaaaggcggacagattcataaatactctggtgaagtcgatgtcgcaccaacccttctgcacctgcttggcgatgatacgaagaactatttaatgtctggttctgatatcttatcgaaaaatttcaaggagctagtgccatttagaaatggtgacttcgtctctaaggattacacaaaagtaggcaataactattacagcaacaaaacaggcgagaaaatcgagccgactgataaggcatcacaagaaaatgaaacggtgaaaaagatgcttgagacatctgataagattgtcaccgaagatttactccgtttctacaagcctaaaggctttacaccgattgaccgcaatcaatatgactatacaaagaaagtacaggatgaagaagattcctcttccgccaaagatgaatccagctcttcatcaaaataactttctcattttaagaaccagccgatccctgatcagctggttcttttcacgtttgactgctattgcactgggtatagaaagaagaaggagggattttatcatgaagaaaacaaccgcttttgttatgactgcttcactcgctacgtccgccctcattggattcagtcctgcagtctcagcacacgctatgaccaaaacagcagtcgaacaatccgttcctcaaggtccgaataccgctttaaacaacatttatgaactggcacataaaggacaaatgccgtattatgcaaaaggtcttaaaattggtgttcaaacaaagaaggctgtccatcataaactaggaaatccatatccagaaacaggtcaaagcagctttgatttgtatcatgctgaaatggggaatccgggatttgcttttcattatgatgcaaaaggcaaaattgacgaaatccgttatttcggaacaaatgtagaaaaagaaacgaatatcggcggaatgaccccttccctattaaagaaacaacttggacaagcggattcggtcagcaccatcccacagacaaaagagaaaaaatacgtatatcgtactggagattatgagctggaatttatcgtcggccatgacccagatataaatcagcagaagctcaccgtcctgcatattaacctagtgaaagctgatgcctaaataaaaaaagcatcctgagcagaagctgaggatgctttttctttattatgaagccacttctaaatgcggctttcttttcatttttcgtttcaagactggacctgcgacataatcaagtccaaatttgccagcatttcctttcgcagccatgatgacgatagcaatgactagaagaagcgggttgacagagacggtaccagctagtaagaaagagacattcatcatgcttccgaaaaaggctgccgttgttgtgaataatccaacaattaatcctagacctactaaaatttctccccacatgaccatggtactgaatagtccagcattcggcaaagcgacattttctaaaaaccatacatagaacggatacacgagatgtccatctttgacaacaggttcagctatcgcaaattgtaaatatcctgatgcatcgaatccgcctgttagttttcctataccagatgtgagccaagtccaaccgatataaagtcttgctgccaaaaggataaccgctgcccatacattcgtttgtaagaattttgtaaacatgatgatgccccctttaatttatgtgaatttcttcacattttatttatgatcttattatactacgttaaaactaatttgtgatctttttcacatacatattcacaaattgttcatgaatatctagttgaggtaacttttcccttgctaaatccgtcttagtcatttcagacaaagaaaagaggtttcattttgtatgaaaacattattccattttgcttacttacaggcggtgtcgtgtctattccccgtcatgatctttgcggcgcttgctctatcaaagatggtgacgattccttatctacaccggtatgatttcattctattgctttgccttcttgcccaaattctcatgctgacgcttcggctggagacattgaatgaattgaaggtgatctgtctatttcacctgataggtattggcttagaaatgtataaagttcatatgggttcttggtcctatcctgaagaagcatatacgaaggtctttggggttccgctctatagcggatttatgtatgcaagtgtagcaagctatatttatcaggcactgtcccggcttcgcgtgcaggttagctcatggcctcatccgtttctttcgatcgggatcagtttgtgtatttatctcaatttttttacgcatcattggttctatgacctgagatggtggctgacattactgcttgttgtcgtatttcgaaaaacgtccgtctcatttcaggttggttcttctacctttcgaatgccgcttgtcgtctcattcttgctgattggtttctttatttggattgccgaaaatgtcaccacctttttaggggcatggcaatatccaaatcaacagcacgcttggtctctcgtccatcttggaaaaatcagttcttggtttttacttgttgtcatcagtattgtgctcgtcatcgaacagcgcaaacaaaaaaacgttcagcccatttaacctggctgaacgctttttttaatcccgatcgacttccttgcgaagatcatctgcgacaaattctacattcgttccgatgatgatttgtacggagttttttcctgaagtcagtacccctttggcacctgcttttttcaaagtactttcatttaataattgtgtatcttctactgttaaacgcaggcgggtcgcacaatgatcaatcgtagtgatattgtctttgcctccaagtccctctagaagaatacttgccccttctgtcttcgtatcatcggctgcaatatcttcaatctcatcatcttccctgcccggtgttttaagctttaacagtttaatgaggaaatagaaaacaacaaagtacaaaatgccataaagcaccccaacgccaagcagcatgagtggtttttgtgcaatgccaaagcttaaaacataatcaatcgctcctgctgaaaaagcgaagccgctatgaatcccgagaatgttcacaataaagagcgagagacccgttagtacagcatggacaccatataagagtggagataaaaacataaatgaaaattcaattggttcagtgatccctgtaataaatgacgtcagcgccatcccaatcatcaaaccagccgttgcttttcgcttttcaggctttgcggtcacaatcatggctagacatgctgctggcagaccgaacatcatcactgggaagaaaccagtcataaagacacccgcgcttggatctcctttaaagaatctcgctagatctcctgttgccccgctgaattccccgaattgaaaccaaaataagttattcagcacatgatgaagccctaatggaatgagcaaacggttaaagaaaccaaacagccctgcacccgttgcaccaagacttaaaatccattctcctaaaccattgatcccgctttgaatcggaggccatacaaatccgaaaacggctgctaataaaatggtgaaaagtgcggtcataatcggcacaagccgtcttccgctaaagaaacctaagtattctggcagcttcgtatccttgaagcgattgtacacataacctgccaatagcccgcataaaataccgcccaatacccccatattgttcgttgaattaatcgacgttgtaccagctgataaaataaaataagagatcgcacctgataatgccgctgccccgttaccatcctttgcgatgccgatcgctatccccattgcaaaaattaaagccaagtttgcaaaaatggcatttccagccgcatgaataaacgggatatcgaatacatcctcccgcccaatagccaaaataatccctgctgctggaagtacagcgattggaagcataaaagatttgcctagcttttgaaaaaactgaaacaccatctgccttctccccctttgtcatcatcatgacctaatcgtttcgtccatgatgctcataaaaaatatatcatatacacatctagttatctataccaatttgtccacattcgtttgaattccgctctttactctttttgcgtaaaatgtggtaagctattgaatagaatgaagttatagaaagcgggaatgaacagtgattgtcaaacatgatcatgagttagaagccttaaaaaaagtcggccgaattgtcgctttggcaagagaagaaatgaaaagccaagcgaaaccaggcatgtctacaaaggaactagatttgattgggaaaaaaatattagaggaacatggagccaattcagcacctgaaaaggaatatgacttccctgggacgacttgtatcagcgtgaacgatgaagttgctcacggtattccaagtgaaaaaaccattttacaagagggtgacctcattaatattgatatctcagcagagctggacggctattattccgataccggtatttcattcgtattaggtacaggtgatgctcgccttgaggcattatgccagtgtgcagaggatgcattcctcgaaggattaaagcatgcaaaagccggtaagagacaaaaccaaattggccgtgcagtctacaatacagcaaaagaacaaggatttactgtcattaaaaatctgacaggacatggcattgggaaaagtctacacgaggcacctaaccatatattgaattattatgatccattcgataatgctttgtttaagaatggcaccgtgatcgcctttgaaccttttatttcaacaaatgctgaatcgatttatcaggctgatgacggctggacatttaaaacaccagataaaagcctagtcgcacagattgaacataccattgtgatcacaaaagacgaaccaattatattaacgaagctgtaagccagctgatccccttcttcattggaggggattttttcgtttccctttcacgaatctgtcacgactaaacaaaaatgcctgtggtaaaataggcaaagatatgcgaaaggggtcttatttgatatgtggttcatcatcatcggcgttatctttttgattgaaagtattatcttaacggttgtaggtattaagaaaaaacaatccatgatgacttaccttggtattgtcatcatgattatgacggtcggcatgatcatcgttaccctcaacccgccaaattcataaatgtttatttccagcatatacatggttcataggaagatagaatcagttttcatttattcatacctgcacacttttcacgtccctttttgagatgttacaatgcaggcagtttcaattgaaaggagttttctatcatgcattatggtagcaaaggctggtatgtcgaagaattaaagaagcttggtgtgaccaagcatgaaggaagaaagcttcaaagcttaaaaacatatttccttgcaaatcttcttgagcaaaagaaacctagctcataagcgcttaaaagccgtacatcttaagctgatgttcggctttttttaaatggactgaattcgtttttctaaagacttcctcaccacatctgctaaagcatctacttcaagaacggctttcagcctctctggacttgtttgacgatatttgacctcgttcacttcatggattgtaatgtgatgagacgctttttctactaatacaagagaagcatcagcaggcactaagccttccttcagcacccgtaaataaaaaccggtataccctgtttgctgcacttcctttacaagcttcatgttgccatgcttaaaagatagtttcacacacggctgtctaggctgactcacttcaacaagtgcttctccaagctgaaatacatcgccaatccgcacttttgtttccactagttggtgcacggtcacattctcaccgaaggcagcttcctgtaacggaacccctaagaactgctcaaaataagcataatgatcgtatggaaagacgcagacggctttatcatatcctccatgatgaaccaaatcaccttgaccatctccctcaaaattgaccttattcaaatagacaggctcatgtattcgctttttgttgatcgcggttttgatttcttttccgtttgcataggtcgtgatgggctgtcctacttggattccagctatgtcgtatttcttctgtcccacgatgaccatctcctttgattgtctcatggctattattttacatcgttagacaatgaaatcatagtcgatgcgtgaagatcaattacatgctatggtacgatgagaaaaaaggagagatgacattgattcattatcatgccattgtcacaggacgggtgcagggagtcggctttcgctattttgtacaaggagaagccgtcaatcgcgggatgaaaggctgggtacgcaacacagataacgagcaagtcgagttaaaggtagagggtgagcagcaggaagtgcttgatttcttaaagactgtccggaaaggaagccctttttcaaaggtcacagatatgcagatggagccgctcactgaattagcttattatcaggattttcgcatcaagggatgaagttttcataaaaaaagcctagctttcgctaggctttttctgttccatgatagggcttttcctgataaaaataattcggcttcacaatggtattgtcgtagtgcttgtggaagatgtgggtagcagctggtgagaccggtggaatcagccaagtccagtccccagtcagcttacggtcagccttttcttcctgcttttcgaactgcttgaattgatgtgctgctgtatggtgatcaacaatggtcacccctgcttccctgtaagaatgaagaaccgccacattcaactccacaatggctttgtccttccaaagcgacgcattctttgtcgtgtccagtcctaaaatcgaagcgacttttttcagcatattgtagcgattttcatcggctaagttacgtgcgccaatctctgtgcccatataccagccattaaacggcgctgcattataatgaataccgccaatctccaatttcatatcagcaataatcggaacggcgtaccatttcagtcccaaatcacgaaacccttcatattccggatgggtgatctcgacttcttgaacgatttccttcggaagctcatacagaactggcggttgatcctttagctgaaacatgagaggcaggatatcaaaatgcgtgccctcccctttccagccatgggcttcacacaattttgttaattcaagagaagcctcgtcgccgatgatgccgtactctgtctcatagcctgcataacgaacgagctgatgattgtaaatgatgacttccttttgcgaatcattttctggaggaaagatcgtaatggatggtttgattttcccaccatttgtcgcatattcaatatgatgaaaaagtgcctctttcacctcttcttctgtcttcacatgacggcagtcgcgaacatgcagggttgaccaaaataaacggccaatgcagcggttgctgttgcgccatgccattttcgccccgtgcgccaattcctcttgtgtgtgagtatacgtccctttagagtcaatttcttgttttatttcatgcagccgtgctgctttctcttcatttgacttacccaattcttcatagcatacagaaataaaagcttctgcttcattccacaacgctccttgattactcaaacatactcgcctcacttcaatacgaatatatccattgtagcggtttctatttataaattcactagtttcaaaccattttttatcatatcatccgaccattgtccttagagcgtggatgaattaatccgtttaagggtttgctcgagccagcggacatagcctttttccctttcaattgcccttgtcagcactaaataatgcccaaattgcgctgaatgaagcgattcagcaccaggatcatcctctattaacgcgtgcagcttctgctttagcatgtccactttcttcgtgcgctctagcagttgatgtgtaagcaggtcggccgcttcttttttgtccatggaggagatgaaaaatgttttgagcatgaattcatcttttgttgtttctgggatcgggtcttttgtccttaaccactgatgcaatgctgcttgccctgcctctgtgatttgatagaacttcttctccagcttctttccttgtatacgaacatcaaattcaataaacccttcttctgtgagccgtttcagctcagggtaaatttggctatgtttcgcactccaaaactgtccaagggaatccttaaaatgcttagtgatatcgtatccagtcagctcacactgatctagtaagccaagaatggcatatttcaaaactctcatgatgtgcctccaacgcttattctttgacattagtataccatagactttaaaataaacatgtaaatcacgacatgtttgaaacaacatcattctaatgaaagaaggaataaacatggatcaattcgttggacttcatatgatttatacgtatgaaaatggctgggaatatgagatttacattaaaaacgatcacaccattgattaccgcattcatagcggaatggttggaggccgctgggtccgtgatcaagaagtgaacattgtgaaattgacaaaaggcgtttacaaagtttcttggacagaaccaactgggacagacgtctctctgaactttatgcctgaagaaaaacgcatgcatggcgtcatcttcttcccaaaatgggtgcatgaacgtccagatatcaccgtttgctatcaaaatgactacatcgatctcatgaaagaatctcgtgaaaagtacgaaacatatccgaaatatgttgttccagaatttgcggacattacgtatattcatcatgcaggtgtaaatgacgaaaccattatcgccgaagcaccatatgaaggtttgactgatgaaataagagcaggacgaaaataaaaagcagcacgcactgtgccgcttctagattgtagacaaagggctaaattgatgttgactttagccctttgtcttttttcagcgtgatagaaaatctttgcagtataggacacgttgagagctaaaatcattttagctcttttttatttaatgcctaacgtcctgttagatagcaagaaccggtacactggcagttcatcgcctacttttgaagcaatcaattcagatgacatgtagctgtcttttgattctggctcaagggcaagtgacaacaaattcgtttgcggctgcgccgtgacatatacctttgtcccttttggcagctgacgtttcttttggatgagttctgtttcaagctgaatatctgtttgactcttttcgtctcgttttgttacttgataggcttgtaccggtacttttacactggcaggtaatgtgacactttttaaccctaaggtctgcagcttccgttctaccccttcatgcccaggtaaaacaagataggctgtcggtcgctctctcgacttgacaggaacagcgtcgctcgcactgtgaaagcgtacagggacattgatggtctgtcctttttcaatatctaccatttcaagcgaatcttccaccggcgctttgaaatcatcttgaatgaccacttgatcgtcatcattcgattggagaccttttttcaccagcttcaaacgctccgtcaccatttgctgcttcacctgctttgcatgtttcaccgttgtttcaatgattttttcatgagtggtgacttgtgctgcgacgcggcgggtaaagtcttctcttccaattccaatccctctgctttctacaagaaaggatagtgctggcgagagcgccaaggcatttcggccaattcgtgcatccgttccgccttcatagagatcgatctttccatcctttcctcttgtgcttgtataatataaatcatttgaaaatccttgatttatcagcgtttcacggacgccgctcacgtataattcatttgacgtgagccggatgctttctggaatattcaagttcttccctgataagatcaataaatcgtgatatttgagtgcacccgctgagccgatatcctcaaactgcttttgtcctacatcgtattcatgggcatcaatgaccacttctggtgcatatcgattaaattcttgatgcagggctgttagctctggagattctaatgtcatatgatcacggttcccatccattccgtttgcaagcctgcggtcaaacgcataagaaccatcagggttgattcttgggacaataatgacgttgacatggctgagtatacgctctccttcatcacctgctaatcgttttgcgatgacgagagccgattcaccggaggccggttcatttccgtgtatttgtgcttgaagccagatcgttggcttttttgaaagtggagaaatatgacgatcctttgtaaagtagagggctggaatggaccgtccttcaatggatgttccaatctgtttctgcgaagcataaggacttttgcggacaatgtcacgtaagaattgttgaagctcttcttgtgtggtgaaggcttctccttttttctgaaatgcgggggtatcgaacgtctcggcaggctcagggtatagcttcttcactggggctggctgttcataattctttccataataaggggtatctgcatgagctgaagctgggctcaccatcgacaaacttcctgctatgagacatactgccgcaaaaagaatcgtgccttttcgtttggacatgctatcctctcccttcgttgatttgcattataaagaaaaaaacagtaaaagtgtcagtatttttcaaaaatatatcttttggaggaacaggcatgcctattgtatagggcaaatgaatcgatcctgctcggcaatatgaactaaaaaaagtgcctgctcacgtagcagacactcttttatttaccaaatggagatggccccaatgagtaccgacatgaccgtcatggcaacaactgcaagcacagcccatttcatcccaaacttctgatgctgatccagtgatacaccaacaagtccaacaagtaaatgtgtggatggaacaagtgggcttaacatatgaatcggctggccaataatagaggctctcgcgatttcaattttatcaacaccatatgctgccgctgtttctgataggatcggcaggaccccgtaaaagtatgcatcattcggcataaagaacgtaaatatcccgctcgttaacgccactatgactggaataaagccgccaagctgctcaggaatggcagaaacaatcgatatcgccatttcatcaaccattttcgtgccagttaagatgcctgtaaaaacccctgccgcaaagatcatggaagcaatcgctaagacgttggttgaatgagccgcaatccgctcacgctgctgttcaaggttcggatagttcacgataattgctacacaaaaggcaagaacaaataggaccgttaagctgacttttcctgagacgagaaggagtaccaataacaacgtaagcgttaggttaaaccaccaaagtttcggtcgcttgatgtcatcctgtagtgccgctgccatttcatttgcatgaatcggctgttcgagctcaataacgccaagacgctttctttcagacttcccaagaaagtatgccaccacaatcatgctcaaaacccctgcaccaatgactggaatcatcggaccaaataaaagtgatggatcaacgccaagtgcacttgccgctctaggtgtggctcctccccatggaatcgtattcataatccccatgccgactccggcaatccccgctaaaataattggacggatgccaagcagcgtaaataatggaagcatcgctgttgttgtaatcatgtacgttgttgtcccatcaccatcaagtgcaacaagcatggtcaggacagctgttccaacgacaatttttaaaggatcgcctttgacaatgtttaaaattttcgccaccatcggatcaaataaaccagcatcaatcataatgccaaagtacaaaatcgcaaacatgatcatgaccgctgtcggtgcgacttgctgtacacctttgacaatcatgtcagaaatttcagtaaaatgaaaacctgcaataagagcaaatgcaattggtgttaataccaatgccgttaaaacagacatacgtttcgtcataatcaaaaccataaatacaaccatcataagaaatcctaagattgctaacactttgttcaccccttatgttgtatacgctttcattaaatgttggtatcccatttccaaccctttctgtcatgatatctgacgcctgaattgaagtaaatattatgaattttaattctttttcgggcgataaatgctttttgttcattttgttcaaaccttgattttgatgaattccatgaaaaaaagcggtcttactcgaccgcttgttccccttggataaactgctcatatcgccttaattgatcttccataaagatctttgcctctttgctgttcatataacgacttgtccagcctttttgcttcatttgctttttccaggacttcgtttgtgtcatttgataaagaagctgatcccattctcgaatgtcgtgctgattcatttgctttggccccatcacaccacgccaatgagagaagataagcggaatcccttgctctttccaagtgggaacgtctttgaatccatctaagcgctgattcgttgtggtcgcgacaagcttcagtcttttcttttcataatcatgacgaacctctgtaatcgtcgtggttgccgcatctacttcatggtcaatgagtgcttgaaataaatcatctgcactgtcaaatttcaaaaactgaatgcggtatggatcaattcctgccatttcggcagcccgtgcgaatgagatttgatcatcatttccaaagtctggggcaaacccgatttttaaggaatccggtttcttctttagtgcatgtaataactccttcccatttgagaaaggagagtcaacaggaactgcaacgacctgccactcttcagcaagaatggcgagcggggtgacatcattcatggtcacgttactgctgcccagtaaattacggcttaataataggcttgaatttaaactaatataattggcatctcgctccatcatatatgtccatcctttatcaaccgttccgcctctttgataaagaatattcacaggctgcttcaccagtttttcttgttctagcacggttttcatcacttgggccgtttggtcaaatccgccgtcgggtacacctgataccacaatgtataaagggctgtactccaggaaagaaactcttgctgttttttcattaaaggtgagcgtcgtacaaaggcagaccaagatgataaggagtattccttttttcatttttatgactccacttgttttttagcaggataatattttcgttctggtctgccaatgattccatatgccagctctgcccggcattctcccgttgtcacaagatactctacatatcgtcttgctgttgtacgtgatgcgcccattttttctccgagttcttccgctgtaattccgctaaactcttcctccattaatgttttcactttgtccaaagtcagtgaattaatacctgttggcaagtctcggtcatccttttgttgcgatgcttcctgcatctgaccaaaaaacagatcaatcatcgtttgattgacttcatcttttgaattgattaactctttcttctctttatattcggttaaaacctgagtgaatttttggaccgtcaccggtttgattaaataatgaaccactccataatgaagcgcgtctcttagcagcatcgtttccgttgcagctgtgataatgatcacatccacatcaggatggcgctctcttaaaagcggcaaaaggttcgtgcctagctcatcaggcatatacacatcaagtaaaataagatccacctgttctttttgaagtgcctcccacatatcctttgcactttttgcctttccggcaacttgaaagccttgtaccttttgtatataagattcatgaatcgcagcaattcgaaaatcatcctccgcaatgagtaccttcatcacaacctattccccctttgtgcctttcggtatgtaaacagtgaagatggcaccgccttctttttggttcgcaacttcaatccagcccccaagttcctccagcacttctttgacattggcaagtccatagcctcgcccttctccctttgatgaatgtcctcttgtgaaaagttgtgaaatggctccttcattgacaccatctcctgaatcagacacctctatgataatatcaaatccaatatctgtgatgaacaggcttacgtctcttttctcctgattcaatacggcctcaaacgcattgtctacgagattgccaatgatggtgataaagtgagataaactcatatggactgggagcggctccaatgaactattttcatcaatgtgaaaatgaacttttttctcagatgcctttcctaacttcccaagtaaaatggcttgtatcttcggagagcgaatttgcttcatgagtaaatcatgctggcgattttgaagagtatattcttctttaattaagtcaatggcttcatccacttgctgtaactcaagcaagcccaaaatagcgtacagtttattcgaaaattcgtgtgtttgcgctctaaggtcttctgaatattggcttacctctgtcaatgtattcaggagcttcgtcagctcggtcttctccctgaagctcacaattcctccaaatactcgattgtcctgcaccacttttttgacatttaacacaaaggttttatcattgacgactgattctatgttaggttcaatcgtctctacctttagataggatagaagattggcatttggcaacacttgatcaatatgaagaggcagcgttgaagagacccgcagcatctgttcagctgacgtattcatcattgtaattgcacctttacggtcaaatgcaatgattccctctttaatcgcgtgcagcatcgcttctctttctcgatataatgaggcaatttcatgcggttcaagccctaatatatcttttcgaatactccttgttaaaaaaatggctccaaaaaccccaggcagcaaaacaagaagggcaatataacttaatttgaatagttgatgggctgtcgcttggtcgatatctctttttaaaaattcgacgctgactgtcccaataatttcttcatgactgcctgtttctttcataattggggcactgcctctgacaacggtttcaccatcagaatcacccgttgatatggaggttcctccaaatagcagtgtacttcttccttccgacacactgatggttttccctacatcctcatgatttgtatgaaaaagaacctttcctttttgattggtgataaaaatagcatgcgctcttacttgctccttcatttgctcaagtacagcctgctcttcgttttgggaatctcctgtagccactgatgttttaataggcggcatatatgaaatcgttctagcagtttgcactgccagctgttcagcttggctctgcctttctgatgtctgcaaaaaaccaaaacaaatggtcaataaggcaataacaacaagcaaaagcccaataattaacccaaaaatttttgtttgtaaagtgactttccttttgcccatcctcaccgccacaacccctaatttatgtagattcacccgaatagactctaagaaaatcatatcactttttctcactaagttaagagaaaattcattcaatacaaaaaaggacgactcatgattgagtcatcccaatgtgttcattacgtgattgataaaccagcactcgcatagcctgcaacggtattcactaatgatagacctgtagctgttgcagagaagacaacgagcaatcttgtttctggtgtgactggtacgttcaaaccagtagcaatgccgtttgaaatagcacctatcgttaaaataccggttaacgctggagccaatgtgacgctcgctacttgcgtgaaactgttatctggtgtcggtgaagcaaacagactagctgttacagtaatactcgtgccaactaaagaaagcgcggctgtcgtactaaaatagccagcaaatgacgtaatggttccatctctcggcactgaaaacgccatgtttagtaatgttcctgctgccccggttaaatcaatgattccgcctacaatactgacacctgtcgctgagttaccaaatccgaccaagctagatgttccaacaagaccgcctgcgattgtggttaaaacagctggcgtaccagatgcaaatggaataattgcactcgatcctgtcacacctgttggacctgtggcgccggtggctcctgttcctgttgctcctgttgctcccgtggctcctgtatctccggttgcaccagttgctccggttgctccggttactccggtcgctcctgtatctcctgttgctccggtcgctccggttactcccgtggctcctgtatctcctgttgcaccagttactccggttgctcctgtatctccggttactccggtcgcacctgtatcacccgttactccggttgctcctgtatctcccgttactccggttgctcctgtatctcccgttactccggttgctcctgtatctcccgttactccggttgctcctgtatctcccgttactccggttgctcctgtatctcctgtggcaccggtcgctccggtatctcctgtagctcctgttactccggtcgctccggtatctcccgttactccggtcgctccggtatctcctgtggcaccggtcgctccggtatctcctgtagctcctgttactccggtcgctccggtatctcctgtagctcctgttactccggtcgctccggtatctcctgtagctcctgttactccggtcgctccggtatctcctgttactccggtggcgccggtagctccggtatctcccgtggctccggttactcctgtagcaccagttactccggtcgctccggtatctcctgtaacaccagtcgctccggtatttcctgtggcaccggtatctcctgtgacgccagttgctccggtatctcccgtggcgccggtagctccggtatctccggtatctcccgtggctccggttgctccggtatctcccgtggcgccggttactccggtcgctccggtcgctccggtatctcctgtggcaccggttgctccggtatctcctgtggcaccggttgctccggttcctgttgcaccggtcgctccggtatctcccgtggctcctgttactccggtcgctccggtatctcccgtggctccggttgctccggttcctgttgcaccggtcgctccggtatctcccgtggcgccggttactccggtcgctccggtatctcccgtggcaccggttgctccggttcctgttgcaccggtagcgccggtatctcccgtggcgccggttactccggtcgctccggtatctcccgtggcgccggttgctccggttcctgttgcaccggtagcgccggtatctcccgtggcgccggttactccggtcgctccggtatctcccgtggctccggttcctgttgcaccggtagcgccggtggctccggtttcaccagctgctgctaacaaggtataatctggtgacgaacctggcgtccctaatggcggcgctgaattcaccacatacgtactcccatcgaatgtcacgacttgacctactggataggttggggctaccgctggatcaaatgctacgatgcccgttaagcctacacccgtggctccagtcgctcctggtggacccgctggacccgctggacccactgcacccgccggacctgctgggcctgctggacctcttcttcctctcccgcctggcggaccttgaatcacacaaacacaaggatcttttccgcagcaaggatttttcactgattttcctggcttacctgatcttcctttcttacaactatcacattcccagccatcatccttatacgcatcataccagcttcctttttggtagtggtctgtcgaatgagttggatatgtctttccgcattgtctacatcttctcatggaatcacccccatccatcgtattcatcgttccttggaaaggtgtatgtacatttttatttttattaaaaatattgaaaagacctcgcgctcgatgcacaaggtcttctatttattgaaatttcattgttattttgatatcttttcctaccatactatatttaacatctgctggacgaatcgcctcttttagtttttttaccccatctccttcaaaaaaagtaggcgcactcttgcctccgattaataaaggtgccatataaatgacagcttcattgacaagtgatgcttctaaaaaggaagcactcacattccctcctgcttcaacaagaactgacatgacagaacgttccttcagcatgcgtaacacttcgtgaatatccgtccgccgctctccgcttgtgacataaatttgatgccctttgtctataagctgttcatactttttctgatcatacatatgcgaggtgcaaataatggtttccgccatacgatctgttaaacatttcgcatgaagcggaatccttaatgtggaatctaaaatgacacgaatgggctgggtcatgattgaatctttcacaataagacctgcatcatcttgaataatcgtttcgacaccagttatcacagcatctgcttcttggcgcaattgctgcacttctgttctcgcttctgttccagtgatccatttgctttcttgatcagccgttgcaattttcccatctattgaaatcgctgattttaatatgacataaggaaggtctgattgaatgaaatgaaaaaaaggcacgtttaagcgctctgcctcctgtttacatattccttcttctacttcgattccagcttgtttcaacatggtcattcccttgcctgctacaagcggattcggatcttgcatcgcaatgactactcgtttcacaccacttttgataatcgcttcagtgcaaggacccgttttcccatgatgcgaacaaggttcaagcgttacatacagatgagctcccttcgccttttctcctgccatttgcagcgcatgaatttcagcatgaggttcacccgccttcatgtgagcacccattccaacaatttcaccttgctgtacaatgacggcaccgacaagcgggtttggggaggtttgccctttcattgcttttgcgttggcaatcgccagtttcatatagaacacatcgtctttcatgtgagtctcctttcttctctttcaagggaaagaactccttcaggaaatgaaggagttctattctcatattttttccatccgtttcttttcagaacgatcatagtaaggcaaggaataaaaaagtttatatgatgctcgttgtttacaaaaacagcatttgcgacattcatatttattaatgaggagcacatgcggacaattgagtacagttaggccttttttcatatgttccttgcaaacacttatcatgagaatcccccgcttacattctttttcttaatgagagattacttcttttggaaattgttcaaataagcgcagtacttcggtatacgtgccatcttctcgaatatgataaatcccaccatcatacgagcttgcgtatacatcattgcctaattgtctaatggcacttatcccattcttagcaattctaattgggccggtattgacccctagctctggattccacactacgatatagccccaataatctccgctcacaatatagccagagtctgtgacagagaccgatttaatcgaatactggtgttcattatgctggtttaaaattcttcctgtatgcaaatcaaacaatctcacattcttgtcacggctgacaatggcaatacggtctcttttgctatcaatgaatacgtcatttaacagctctgtcgccccgatatatttggcttttaaagacaagctcttcttatctaaaagacagatggtgccttctaccgcagctgtgatgatatgatccccttctacttttaatgctttcacagcacaatcatgtgctttggaacggccaacttcctttaaatgctctgtcgaaatgacatggacataaccgccgtaagttccaatataaaattgcctgtcctcctcgtggaaatacacactgttgaccggtcctgtattgagatcaaacgaaaccatttgctgtaatgattcatgaacaatatgcacctgacttgcatgatctccccacgcataatagcttccatctctagcgacagccactccatttgttaaaacgcctgtcgatttagtgatttcaatcccattttttctgaattttccgtcatctgatgctgtgataatatctcctgcctcagtcagtgcaatatcattaatagatggtgtcgccatttcgacctcatctgatacaactttccccttttcaatagaccattcacaatacgtttttccaaagctggctcctaggatagatttctcatcttccgtccagacaagcgagcgctcccactgatatttatgaggcagcaacgtatcgactaaatcccctgtttcgtaattccacagcttaattaaatggtcatagcctgctgtcagcaagtaattgccgcttggagaaaagttcacccgcttgacgccctgtaaatgagctttaatgatttttttctcctgtaacgtcaccgcatcataaataatgacggtaccatcgtctctgccaagtgcgaacacttctttttgattgctgccgctgattgtgtccagctcataatcaaacggaccgatttcccctacaatttctcctgtatcatacagccatacaagaacgtagccgtcatcacctgttgtataagctttatcgccatgtatccatacagctaatacatctttgctatgtccatgaaattctcttagaatggctcctgtttcgatatcccagactaagcatcttctatctctggacaccgagacaagcaaggtatcctgcttcgcaaaagcaacggcttctacatcatccgcatgaccaaacaaggtgcgaatgtgagtatgtgtgcctgtatcatacaattgaatggtgtagtctgacgaagcactggctaagtactttccgttttcagaaagagataaagagttaatgatatgctcatgacttccaataaacgttccttctcctgtcgcccggttccactgataaatacagcggtcatagccgccagtgtaaacaatttggtcctgctgagttgataaaacagatgtaattggtcctctatgcataattttacactcccacctttatatgttgtttttgacgagtcattacacgaaagccagtaaatcgaaaaacagggtctggatgcttcccgtgtcttctggcgactctgcataaatctccgcctcttgcaaaggagccgccttttaaaatgtagtaatcactgccaagcgtttccgttaaatcatctacaacctcaatgccgccttcgtacacatgatatttgctgttgacccattcctcgacgttgccccccatatcataaagtccgaataaggatcttcccttttcgtaatggcggacaggtgtcgttttttcaatatttgattcgtacgtattacagtaagaagagtcaaactcatctccccaaggatattgatttctcgtgttaccccgggcagcatattcccattcttcttcagtaggaagcgacacgtctatcccgagtttcccgcttagccactggcagaatgagaaggcttcctcgatctccatgccccaagccggatgatctttcccgccgccaagttcttgattcgttaagctctcagggtacgactggcctgtttcatcacaataactttgataccattcattagtgacgactgtatctgaaatgaaaaattcattgatatacggctgataggatggaaattctttgtacagccatttttgaaattttttctcacgaccgtaagttggattgagaagcttgtccttccagaattctgatgcctttttcatatcttcttcattacttccgattgttgcatagccgcttgggatttgaatccaattgatttcaggtttcacgcttttctcccgccttctttaaagtaaactcatctactgattaattaattttttctcatcgaccatatgccctgaggctgcttttgcttttaaataggcttcattatagagagaggcttcgaccgtatgatcaaaccgcaaaacaggaagaccgtaggcagcaatggaatcgactttatctggattgttcgttaggagatgcattggtttccctttgtttaaatagtgcagaacagccgctgcctcctcgtaatgccggtcatcatcgccgcatccaatcaggcggttggcttcaaacgtatccagctgcatttcctgtaatttatacgtcaatgctttcgccatcagcccaattgaccgcccttcttgattggccatatagacaagcatgccttttccgtaatcggtgatttttttcagcgataacgcaagctgtggaccgcagtcacatttcagtgacccaaacacatcccctgtttggcagacactatgaattcgcacaagcggcggcatttcattttcaaagtcgccaaataagagacaagaggaaaaggtttgctgcgcggtactcatttggacaatagattcaatcgttggttttgtctccccttcaacaggtgcgaaggcataccacttaaatgacacttcttcatgttgaatggagatcggcaggttcactggtcccacgagcaaatagtttttttcttgaaaggtaaaatgatgaatcattgattgtaattcatctacaaacttattcatttgtctcccccctattcatcgctgcacccaaatcgactcaggaagcgcagtgatggtggtgaatatgtgtccgcactcatggcttaaaagaacatggatatgcgtttcctctcatcgttcagaccttgattccacctattctagcgatagttcaatcttggtcttttccagtacaaaggagcagaattttgggttcatcacgcctttctcttacatgatgcgcacaggctctttcttagaatgaacacctctgctacgtctgagtgttcacctttgtactagattttgacggcaatgacatggtgctggcttatgccggcttttgcttttaatggtgtaatcgatacaagctccagacctgatgaacaaattctttctccaagctgagagtctgaaaatgaaaagtggaaacggccatcttctccgattagccctgttctccactcttctccccatacaacaagtgagaagactccgccttcttgaagcaaagaggacacctgttttaaataacgctcatgatcatcagggtgctggtgatgaaagcagccatgatctaaaattaaatcaaactgcttttcccgtccctgatccatcgaccaggacataaaatcttgatgaaaaaaatagacagggaccgtttctcttttctgtaaccctccccactcctcatgctcatacaggtcgatgccgacatattcggaaagtccgcttaaatgttcaagtgcccggccgttcccgcatccgatatcgagcacagaagcaagtgcatttttttcccttgaacgccaagcttttaatgacatcacggctgcatctgttaaggatggatcagtagaccacatatctgttcttttctcataatgttcttgaaatgccatacgcattttttctagatacaacccactgtcttcatggtataaagcctttttcatcacaggacctccttctatttaaaatcgacttttcgggcaaaggtcatttccaagccaaaaaccttatgttaaaataaaagatggattttttaggaaatctgttttctgaaaaagaagagaagcatcccacatgttcactcttctttttcagcgtgcatcctcatatgcagccatttgaaagctgaagcgcatcagcttgttttctctttttttcatatgagttcacctccttcaccgttcgatcaactcacaaccttttttgaaaccgctttctcctctgtacaaaaacatgacgtcttttctatatctcttgcaaagtgatcatagtagaaaggtcaatctactgtttagatcggctgccatattttcttcaagtaaaagaccgttttcttatgtgttagtagacatattccgagtaagctttttctcttaaaagcacttataccttggttttatgacaccacctttcactagaataagccttgaataaacccttcagaattttaacaactacttccataatgactggaataagccaaatatattgtttttagattattttgtcaacaaattatttcctaaacattaaaatgaattttctaattgaaaatacaggtatttttcgtggttttttgacctcaaaacacttatttctacacaaaaatacaacataaaccaatagaactaagaaatttatctactaaattacacaagatttttattacattttgaaacaaaaccgaaagatacaatgattatttcccgaatggttttttgtgaaatttttactattcttttcttatttcctatctttttctttggtatatctgcattttcaattagatgttttactgtttattccaatctgctattttttctaaatatagtaaaaaagatgcaacctctccttcaaagatgatggcatgaaaaaaagccccttacaaaagtaagaggctttttctcagttggcgtttatgcccaagttttcactttttcatggtctgtcacaaacagaaggacttttccttcatctaaatgttcttcaaatttctcagcttcttctttagagaaaccaatttcatggattttatttcggagctcatcaccctttttactaaagatgttcccaacagcatgtttcagtccaacttctcttggacctatcgtattggcatctgcattcccagcaatacgctctgtacgatcatcgtcatgggacagaacataaatgtcctctcttgcaacaccgagtgattttaattgctctacatctctttgaagtgtttcatcatttgaatactctcttacaacaggtttcattttttattcctcctttagcgtcttacgaatcttttacccgtcacttttatcattaaaccttccttgagcacatccattttacattgagtactaaccatgcctattgacttatttttgacaaaaaccctgtaaaaatgactaaattttctgaaatattgtgttcatccctgctgttttgttgtacaattcttgtactggaggctagaaatgaggtagagctgatgtattacttttcagcggagcagcagtttaatgcttgggttgtcagtgatttggtgaaacagctttttcaaaagtggaatcctgaagaagcaaaagcagagccgcttacattgtttgctgaacagcactttcgcatctccattgattatctcttttccatcattattaacattggagatatcgagtcgattgaacaagatccacaagacctgttgtcctcatacttgaatatcctttttccttttgtgacgcgcgatatgatgaaagcctccatgcaaaatgcgaacgaatatttgttaaaagaacgtgatgcggacgtgtatcagctgtttggctgtctgccgccgctcctctctgttgactttcaaaaaagtagtcctcatctatgagatggcggctgcttttttgtatgtgtttgaaatagaccgtatgttttgaatgaaaagaagcatcatgttaatgtaaatctaggctgcaagtgaaagggaggatttgacatgagtcagcaaaagcaaattcaattagccaaacgtccacaaggattacctacaaaagatgtttttcattttgaaacagtcgatatacctgtgccgcaagatggtgaagttttgattcaaacgaaatatgtttctgtagatccttatatgagaggacgaatgcaggatacaaaatcctatacacctccattcaagctaaatgaagtgattcagggcggtgttgtcggagaagttgtcgagtctaaatcgcctcaatttgaaaaaggtgattttgttctcggattccttggctggcaagaatattccacagccaaagctgaatctctcactaaaattgatccatctatcgcgccattgtcctattatttaggcattttaggcatgccagggcaaaccgcttatttcggtcttcttgcaattggccagccaaaagaaggcgagaccgttgtcatttctggggccgcaggtgctgttggttccgtcgtgggacaaattgctaagatcaaaggcgctcacgtcgttgggattgctggatctgatgataagctggcttatttaaaagagctgggctttgatgaaacaattaattataaaacaacaaaagacttagatgatgctattgcaaaggcgtgccctaacggcgtcgatgtgtattttgacaatgtaggcggcgaaatatctgatgccgtgatgaatcatttgaaccgcttcgcacgtattccagtgtgcggcgcgatttcgtcttataacattagcgcaagcgaggacattggaccgcgtgttcaaacaaaactcattaaaacaagcgcattgatgcaaggcttcattgttgccaactattcagatcgttttgaagaagcagcaagagatctcgcacaatgggtaaaagaagataaactgacttataaagaaacaatcattgaaggctttgacaacattcctgatgcattcctcggactattcaaaggggaaaatgtcggaaaacagcttgtcaaaatttcataaaaagaaaggaccctccatgtgggagggtcctttttttatgcttgcttgggcgcaaggtgcagctgaccttgcttataaacaatttcctgaagcgaaagatttagctttttcgccatttttttaagcattgaatgctcttgaggtgtgactaggctgataacagctccttcttttcctgcgcggccggttctgcctgaacggtggatatagccttcttcgtttggcaggtcggcatggatcacgtaaggcagatcgtcaatatcgatccctcttgctgcgatatctgttgcaagaagaagcgggaattcacgttgttcaaattcctttaagatgatagctcgctctgcttttttcgcttcactatgaagaacaccgaggtcgacatggtgatacgctaatttctctgcataaatgcttagattcgtaatatcacgcacaaaaacgagcgcatgcatgtcctcaagccgtgatagcttttgcagaagttttactttgtcacgctggtcacataatagataatagtgtcctactttctgcgcttcttcctcacttctagcaattttcaatacttctggttcagacgtcatttctttaatcagttgaaccgtttcgtcttttaaggtcgcagaaaaacaaaggatttgtctttcttttagtgtggatttaatgatcgcttggatcgttttcatatgctctggcacaagaagctgatctgcttcatctagcacgatcgttttgacttcgtgcattttcagtttcttgattttgattaattcttggacgcggcctggtgtcgctacgacgatattcgggtgtttttttagtttttcctgctgctttttaatgttcgctccaccaatcaaggagaccgctttgatgtctgatccttgtttaaactcttgcacaacatcaaaaatttgcatcacaagctctcttgatggtgccaagattaagacttgcgggtgcttgatattcacatcaattttatttaaaagcggcaacacatacgccagtgtcttccccgttcccgtaggcgattctgcgatcacatcacgcttctccgtaatccattctgctgttttttcttgtatagctgttggtttttcgaagccagccgcttggaagttctcttgaataaatggctttgcttctttcaaaaatgcccaattttctatcatgtcgatctcctttatcctcattcaatctatcctttagtatctcaaaatcagctttgaaacgcaatttttcttttgatgcttttatcaagccggacagttcgatataatcatgagaggcactagccgttttgaatctatttgaggtgtaaaaaatgatattatctgttaaagatttaagccatggctttggcgacagagccattttccacgaagtctccttccgtttattaaaaggcgagcatgtcggcttaattggcgccaacggtgaaggaaagtcaacgtttatgaatattatcactggcaagctggagccagatgcaggaaaagttgaatgggcaaaaaatgtccgtgtcggctacctggatcagcacactgtgctagaaaagggcagaacgatccgcgaagtgcttcaggatgctttccactatttattttcaatggaagcagcgatgaatgacatttacggcaaaatgggtgaagccgatcctgatgagctggaaaagctgttagaggaagtgggcgttattcaagatgcgctcacaaacaatgatttctatatcattgattccaaggtcgaagaaattgcgagaggccttgggttaacagatcttgggctggaccgtgatgtgacggagctgagcggcggacagcgtacaaaagtattgcttgcgaaattgctgttagagaagccagaaattctccttctcgatgagccgaccaactatttagatgagcagcatattgagtggctgaagcgctatttacaggaatatgaaaatgcgtttatcctcatttcacatgatattccgtttttaaacagcgtcattaacttgatttatcatgttgaaaatcaagagctcacacgctatgttggtgattatgatcaatttaaacaagtgtacgaagtcaaaaagcagcagcttgaagcagcttataaaaggcagcagcaggaagtggctgaattaaaggattttgtggcaagaaacaaagcacgtgtcagcacaagaaatatggcgatgtcccgtcaaaagaaactagataagatggatatgattgaactggcagcagaaaagccaaagcctgaattcaattttaaggcggcacggacttctgggaaattgatttttgaaacaaaagatttggtcattggttatgatgaaccgctctctcgtcctttgaatctgaaaatggaacgcgggcaaaaaattgcgttatacggcgctaacggcatcggaaaaacgacattgctgcgaagtctccttggagaaatctcaccaatttctggtgaggtggaacgcggagaattccttcatattggctactttgagcaagaagtaaaagagcaaaacagcaacacctgtattgaagaagtatggggcaccttcccttcttacacgcaatatgaagtgagagctgctcttgctaaatgcggattaacgacaaaacatattgaaagccgcgtgtctgttttaagcggtggagaaaaagcaaaggtccgtctttgtaagctgatcaatgaagaaaccaacctccttgttctcgatgagccgaccaatcacttggatgtcgatgcgaaagaagaactaaaacgtgcattaaaagaatacaaagggagtgtcttattgatctctcacgaacctgaattttatcaagatgtagccactgaaacttggaattgcgaatcttggacgaccaaagtattataatcacaaaaaagccttatatctcatgcagatataaggctttttctatttaatgacctgcttgaatattgatgagatgtttccggccaattagcaggatgatcatgcctaacagaacgacagccgccccaacatagtaaggggtgcttgcagtaaaagattcagcaagtacgccggcaatccaaggagcaatcgcgcccccaataaaccgcacggcactgtaagaggatgaagcaatggaacgctcaaccggtgctgatcccatcactgcggtcgtgagcacagtattgatcataccaagaatacccccagcaatgacaattccgcagatgacgactacaacatgtgaagtccagattccaataccgaataaaatcacagcaaacgaagcaaacagaaccacaagagaagtcaatgttccaagcttgcgatgaatgaccggcgctgaaaagacggaagtcacagctaaaaatagtccccatccaaaaaagacataaccaagaccatgctcatccagatgaagcacaaatggcgaatacgctaaaagcacaaagaaaccaaaattgtataagaaagcggcagaagccatcgttaaaagtcctttatattttaacgccccgacagcctcgaataatttcacctttttctgaggtttttgcatcggtggaagcataaacgtaatggctaaaagagcaacaagcattaacaccgcaacgccaaagaatggaccgcgccaagagatcgtcccaagctctccgccaagcagcggtccaaccgaaatcccaagacctagtgcagcctcgtataaaataatggccttcgcacttcctccaacagacacaccgacaatgacagagagagccgttgaaatgaataaggcattcccaatcccccatccccctctaaagccgattaattcattaatcgttgaagaggtaccccctaaagcagaaaagacaataataaaaataagtccgattaataacgtccatttcgcaccaatccgactagagataaagccggtaaaaaacatcacaaaaccagtcacaagtaagtagctcgtaaacaaaagagagacctgacttggagatgcatctaattgtgatgcaatggcaggcaaaatcgggtccacaagtcctatccccataaatgaaatcacacatgcaaaggcaacagcccagacggccttcggctgcctaagcagacttgtacgctgttttaacacttcttcttccttcattccatcagaacctttccttcatatgttcacaaaataaaataaacacactgaggtgtttatttttgtaattgctcaatcgcatgagccgctctatctttcatcgtttcaagatcctttttaaaggattgaatcgtttcaagcttttttgtaatcaattgatgctgcacagtcagctgcgcctcaatatctaacagtttttctaatcgttctttcggatcaagcgacaacaaatagccttctttattcagctctaactgcttccctatttccataaacgattgaagctcttgtaaagaaaagccgagtacctcttttgcctgcattactttttctagttcttccatgtcgtcctctgagtacagcctgacaccgccctctgtccgctttggtgctgataataaaccaatctcttcatagaaacgaatcgtccgtttggtcagtccgcttcttttcgccactcgatcaattttcatccattccattgccagtgcctcctgctcatcaattcatgatttattatacacctttataaccttaacgtaaacgtaaatgtttgggttcttgattctctcgtgttttgatgaaaataaaaaaaaacctgcaaaatgttctgcaggtttttttatttcaatcattttattaagattaaccctctaattcctcaatcatgatcgacagttctgtccagcggtccattgcttgttctagttcttcagcaacggctttttgttcgtccatcagttcttgaatttgcccaaaatcactgcctgcttctgcaatgcttgcttcaagctgctgatgtttttcctctaatgcctgaatccggtcttcaattccatcccattcaagctggtctttgtaagaaagtttttttctctttttaggcgccgcttctacttgtttctcagcaggctttgtctctgtgcgcttcgcttctttttcttgctccatgtaatcgctgtaagcaccttggtagtgtgaaacgcggccatttccttcaaagacaagcagacggtgaaccactcggtctaagaaataacgatcatgcgatacggtcatgacaacgccaggaaactgttctaaataatcctctaaaatgctaagtgtctccgtatcaagatcgttcgtcggctcatctagaaagagaacattcggttcttccattaagactttcagtaaatacagtctgcggcgttctccccctgatagtttgcgaataaacgtccgctgcatggatcttgggaataggaaccgttccagcatttgctctgctgtcactatggcgccatcagatgtcttaacgatctcagctgtttccttgatgtattcaatgatcgtcagctcttcatccatttccttgtgatcctgcgtgtaatagccaatgcgaacggtttgtccaattgtcaattgtcctgaagtcggttgaattttacccgcaagacagttgagaagcgtcgtttttccgactccattcggtccgataaatccaatccggtcgcccggcacgactaagtctgtaaaccgctccacaaggttctggccagcaaatgaaatcgacaagtcttctgcctctatgacttgttttcctaggcgatgggaaccgatggcgaaatccagctctcccttcgcatcaggccctttttgatccatcagctcttcggctctgccgatgcgtgctttctgcttcgtcgttcttgcttttgcccctcttctcagccatgcaagctcgcgtctgagcaagttttgacgcttcgtttcttttacctgagcttcggcttctcgttccgctcttttttctaaaaagacttcataatttcctttatacgtataaagctgtccttgattcaattcgtaaatccgattggccacccggttgaggaaataacgatcatgcgtcaccagaatgacagcaccgctgtattgactcaaatatccttcgagccattcaatcgttgcattatcgaggtggttggttggctcatctaaaatcagcaatcctgcgggctgaattaaatttttagcaatcgcgacacgctttttctgtccgcctgataaagcatgaacaaagcggctcacatctttgacgccaagctttgtcaaaatcgtttttgctgataggttcgcaccccatgcgtcttcctgatccattcgattttgcatgcgcatgagtgcctcttgttttgcctcattttgcggatcatgctctaaatcggcgagtgcctgttcatatgccttcatcgtttgaattatgggtgctgttccagaaaaaatgtaatcgagaatcgtttcatccccgtccatttcgggatcctgctcaagaaattcgatatcaagtgtccctgccttcgtgatgtcaccttcctcaaacgattcaagtccagcaatgacctttaggagcgttgactttcctgttccgtttggtccaatcaatccgatgcgttcctttggttctatatgaaaagaaatatgatcaaacagcgttttctcgccataggttttatataatccttcaacattcaataaactcatttttatcagcccttacatagattcttcctttattttaaatcagccagttgcagaaaactagttttaaaaaacccgcagctgaaaagaatgtttccttttgctgctcgatacactatgaagaggtgatctaaagatggtaaccattagcttatgtatgatcgtgaaaaatgaagaggaggtgttagcggactgcctttcctctgtccaagacattgtcgatgagatgatcatcgttgatacaggctcaacagatcgtacgaaagagattgctcactctttttcagccaaggtacttgattttgaatgggttcagcattttgccaaagcccgcaatttcgctttctcacgtgcaacgaaagagtatattttatggcttgatgcagatgatgttctgcttgaagaagaccgtcaaaaatttcttcagctcaaagagacactcgatccttctgtggatgctgtctcgatgttttatcatgtaggattcgatgaagacggtcaggtgaattttaaatatagaagaaatcgccttgtgaagcgtgccttgaactttcagtggtacggggcggttcatgagtttcttcaggtgtatggaaacatcttaccagccgatatagccgtcacacatcaaaagcgtaagaaaacaaccgctggtgaaccagggcgcaacctgcgaatttatgaagacatgctggcaaggggagaggacatgacgccccgtgatctcttttattttgccaatgaattaagagataacaggcagcatgtcagagcaattcgtttttatcatgagtttttagcgacaaaacagtgctggattgaggatgaaattcgcacatgccaatatttagccgactgctattatgcggtaggtttcgaggaagcggctttatcctcattattacgttctttcttatatgatcagcctcggccagaattttgctgccgaatcggggatcatctaaaaattcaaaataaacatcaggcagcgatcttttggtatgagcaggcgctgaaggctcctgaaaacgaagcagccttcacactcacacattataaaacgtggtatcctcaccttcagctttgctattgttattatcagctcggcgatttggagaaagccaaaacacatcatcttgcctccgccgcccatcacccaactcatccaagtgtgctgtataatgaaaaaatatttgctgaacagacataaactaaactatctatcaccacatccgccttccatctcttggcggatgtctcttttttagcaaaaattcgattgtggcgtttaatactttagtggtttaaagcgttcttcaaccaattgactaaattgtcatttcagcatatactaacactcgtcttacgaaaagatttatccattaggaggtcaacatgagttctttatttcgaaaaaagtctctcgaccagctcatgcttgaaagtcaaacgaagcggctcagccgatcgttaaatacgtttgatttaatcttgcttggcattggctgcgtggtcgggactggtatctttgtgattacgggggttgctgcggcaaaggatgcgggacccgcgattattatatcttttattttagctgcgatcgcatgcgcccttgctgctttttgctacgctgaattctcctcatccattcctgtatcaggaagcgtctatacgtattcctatgctacacttggggaatttctcgccttcttaatgggctgggatctcatgcttgaatatgtcattgcactctctgctgtagcaagcggatggtcgtcctatttccaatcactgctcagtggattcggtctgcacataccgaaggctttatcagctgcacctggagccgctgatggggccgtctttaaccttccaggcgcactcattattttgcttatcacctttatcgtctcaagaggcgtcaaagaaagcacgaagctgaataacatcattgtgctgattaaaattgccattgtccttctctttatcatttcaggctttgcttacgtcaaacctgaaaactggacaccttttatgccgatgggcttccacggcgtgattgctggagcggcgactgtcttttttgcttaccttggatttgatgcaatcgctaatgcgtctgaagaagtcaaaaatcctcaaaaggcgatgccaatcggaatcatcggtgcgctcggtgtttgtacgattttatacatcggtgtttcattcgtcttaacaggcatggttcactatacgaagctgaatgtcagtgaccctgtcgcatttgctcttcaagttgttggcctgaatagtgtggcgggcattatatccgcaggtgctattattgggattacgacagtgttaattgcacttgtttatgctcaagttcgtttaacctttgccatgagccgagatggactcatgccgaaaatcttttcaaacgttcatccaaaatcgaaaacaccggttgctaacacttggctcacaggtgctgttgcggcatgtatcgttggattcgtcaacttatctacgctagcgaatttagtcagcataggtacacttgcagcctttacagtgatctctatcgctgtgatcgtcctacggaaaaaacatccgaatatgaacacagcttttaaagtaccctttgtaccttaccttcccattattagtgcggtcatttgtatgatattggctgctacactgaaatgggagacatggagagccttcctgatctgggtggccattggtgtcgttgtttatttcacctatgcaagacgaaaaagtcatctaaatgaaacacattagaaaagagacacggggtttcccggtctctttttttttgcttaaatcacgctgtttttggctgaatttgagtccaccatatctggatctaacacgcttgaaatcggaatgacaagcggtgaacaatctccattatcctctccaaatccttggttcattttcatcgagagaaaataatcgatctgctgataaggacctagcgtcagtgatgcaccccgatccattgcattgattttaaaagcaccgacattgacgacagagggtgagaataacatcacacgtcacttcctttgaatgggtttagctgttggtgaaaaagaggcaggtgagtccacttgatctcgatcatctacatggctttttgtcccgacaaaaccgctggcatctccaaaattttgtccgtacccctgattttttttatctgagttttgccactctgctaacaaattttgtccgacattcaccgccgacgcattttcaaaggaattaatttttaacatgaaaatattaatattgatatacggagttggttgaaccacagataaacctcctttttataggtatatgcaagcacccatcaagtatgttaacaggaggtcttcacatggacttcgaaaaaatgaagcagtggatggatattgcccagcaaatgcatggggacgatttttggaaaatgatcttcgatgatgagcaaagatctccttttatggcaaatggtccatctccatttacgttcacgcagcaggatcagcgcggcccagatgcgtcgttcccaccaatcgacatggtggaaaccgcgacagaaattcagtacttaatttatttgcctggctaccgaaaggaagatgtacaagtgttatcatatggcgaatatttggttgtgaaaggacagcgtttttccttttttaatgagcaggattttcgccaaaagcaggggaagtatggtccgtttgaaaagaaaattcggctcccagaaatgattcttggccaaatgaatgcagcctttaaagacggtgtgctttatatcaggctgcaaaaagatgaaggaaaagcgactgctattatcatagatgacgaatattgatactcacggcgtcgatttgatcacgatcatcaatcgattcaatcggcaggatcgtgatcacgccatcagcattctgttccccaaagccattgtttcttttaatcgtactgcaatgattacaaacaaacgtcgaaccaaacgtcatggacgatcctgtgcccattgagttcgttttcatatgggcaatgtgtatatgagtaggcagcatgtgcttctcccctttcttgtcatctcaataagtatatatctcacagcttttccatagactagatcaaggcagaagaaaaggttgtggtctacttgaaacatttcattctatcactctttaaaaaaactgaatccagtccatcctcctctgtcagtgagctggaaaaaaggctcaccgctcttgagcaaaaaatgtctgcaccagcttcccctgtctcagaggatacacacattcatattgaatccctgcatgtggacaaaattgattaccatttggagtttggtgagctttccattgaccagcttcaaggcagactcaatattggggcaacctattacacgccaaaggacactcacatcaaaaaatcaacaccacaacaaaagccaaaagaaacaaaaacaccgacggtctcgattcgatcaaagccaccttcgtaacccgctcagcttttaagcacagccgggagccagaaatacaccgcaaggacaatcaccacaatactcatgatatttaaccaaaagcccgccttgaccatatctgatattttcagcacgtctgcactaaaaacagcggcatttggcggtgtggaaatcggcagcataaacgcacaagaagaagccaaagcagccgcagccattaacccatagggctcgataccaatcgcaagcccaagccctaccgtaatcggaatgatcatattggcaacagctgtatttgacataatctccgtcataaacaaaatcgctcccgttaaaatgatcaatagcatgagataagataggccatttaaatgctgtagattttccccgatccaccctgttaaattggtttctgcaaagcccgtagcgagcgaaagcccacctccaaacaaaagcaacagcccccacggcagctgtttcatatcctgccattctaatattctctcaccgtttgttgctggaatgagaaataatagcatggcaccaaaaatggcgatggatgtatcggatacggcggctcctccaaacaaaaagagtttaaaaatccacaaaaacgccgtcatgagaaaaacagcaaacacccatttctcctcttgtttcattttccctaaattctctaatccctcccgtatgaacgttacactcatttcacctgtgtgctctaccttgaactgtaccttggtcaaatacaaaaataagagaatgagcagaatcatcgcaacaggaaagccaaacaaaaaccattcaaaaaacataatttcccgatctaatagcttttttgacatcgcagcaaacacagcatttggcacagatccgacaagtgttgccagaccaccaattgacgctgaatacgcaaccgacaataaaatgcttttactgaatcgctcaagagatggaccagctaagatatcattagccttgacctctttaatcacagccagtgccaccgggagcatcatcagggctgtcgctgcatttgaaatccacatagataaaaaagcagtcgcgatcatgactcctaatacaatgcggtcacttcgtgtgccaatcacccttaaaatgtgtaaggccattcttctatgcagattccatttttcaatggcaattgcgatcataaatcctcccatgtacataaaaacgatcggatctccataagctcttgatgtctgttccatcgaaagcccgccaagtgtcggcagtaggatgatgggcaataaagatgttgcagggatgggcagtgcttctgtcacccaccatgtagccgtccaagcggtaatgcccaagactaccctcgcagcataggtcaattcattttcaggtatgagaaaaagaatgagcaagaagagtgccggtccaagaacaagtccaatcacattcacctttttataaacgataacaattcccccctattgaaagcgcttgtatatttttctattttccacattcgatgatctcttaagaaatcctttaaatcataagaaaaaatgaagatatctttcatagaaacaagctatcattttcatccctttcccaaaaccatgacatcgtgccttggtctattttcataggataaactatacaaatcatgtgcaatcactgtaaaatatagaagatctaatcaaaaattgaggtgttttcattgtatacagatcaacgaaaatcaatttggaaacagaaaaaagtcatcattcccattcttagtatcatcgtagttgctgctgctttctttttcttaaaagattctcttttctcaaaagaaaaagaggctttaaaagcggctcaatcctttacaaaacaattggagaagaaagactttacaaagctggctgatgaggtgacaagtgcgtctttgaaagccaatgacttctcaaaaaaacaactagccgaaaaatacgacaatatcttcaacggaattggtgctcatgatctgaacatatcaaagcttaacatcgaaaaacaggacaaaggaaatgggtatcaattttcctatgatgtaacaatgaaaacgtcatttggcaagctgcacaagctttcttacaagggcgttctctcagaagaagatgacaaatggaaagtcgactggaagccaaatctcatcttcccgcaaatggagaagggagataccatcaaagtcaaatcagatcctgctgtccgcggaaatatcgtcgaccgaaaaggacgtaccctagcagaaacaactggtggaagcgcacttggcatcatcccaggaaagcttggcacaggggaagaaaaagaacgcaatatcaaaaaaatcagcaaggcatttgatatagatgaagaactaatcgacaatcagctaaaacaagcatgggtcacagacgacacatttgtcccgctcaaatcaatgttagaacagaagccgattccaaaggatataaaaggcgtcacctatcaatcaaaggaaatgcgttactatccttataacgaagccgccgcccatctcaccggctatgtcgggaaagcaaatgcagatgatatcaaaagaaatccggcattaaaagcagatcaaatcatcggcaaaaccggccttgaattcgcatttgacaaaaatttacgcggacaagatggcggaagcattttgatcgtccatgatgaaacaggcattgaagaaacattgcaaaagtcagatcgacaagatggaaaaacagtgaagctgaccattgatgcctctttacagaaaaaagcctataaacagctgaaaggtgaaaaaggggccgttaccatcatgaatccatcatcaggggatctattagcgcttgtcagctctccttcctatgatgtcaatctcatgacaaacgggatcacacctaagcaatatcaggcatacagtgaaaacccagatctcccattccaagcccggtatgcgagccggtatgcaccagggtctacattcaaaaccattacagcagccatcgggctggaaacaggtgtcacaaagcctaataaagtacgcaccatccatggattgaaatggcaaaagaatcaatcttggggcaattatcgaattacacgggttcacgataaagaaaacgtaaatatggttgatgccctcgtgtactcagataatatttacttcggacaagaagcactggaaattggcaaagatacctatgagaaaaaagtgaagacatttggatttggcgaagatttgcatatgccatttacaatgaaaccagcacaagtatcgaacgacggcattcaatcggacatcttacttgctgactcagcatacggtcaaggtgaattactcatgtcaccaattgaacaagtacatgcctattctccatttgcaactggaggcaagcttgtctacccacgagtcgttcaagatgagaaaacagcatcatcaaaacaaatcatcaaagaagactcggcaaatacagtgaaagacgcgctcactcaggtcgtgacgagtccaaacggtacagctcactccttacaaattgaaggagctgatatcgccgctaaaacaggaacggcagaactgaagagcaagcaaggagcaacagacggttctgaaaatggatttttacttgcatttaatcctaaaaaagaagattacgtcctcgtcggtatgattgaagatgtaaaaaaccgcggcggtagtggactcgtcattcaaaaaatgaagcctgtcatcgcatctttttataagtaaccgtttagagacacaagcacttgtgtctcttttttctaaatcatgacaatttgctattgttttatagttcaccttatgaataaaatgagaagaatgcaaaattgaaaacagttgaatgaaaggaggaagtctcattggctattgctgctcgtacaaaggataaacctcaacattctgtcactggatcaacggtttatcccattttattgattattggcatttgtcatatgctcaatgacactttgcaagccgttattcctgcgatgttccctattttagaacgctcaatggggctgacctttacacaattagggctgattgcctttacattaaatatggtctcctctgtgatgcagcccgctattgggtggtacacagataaaaggccgatgccttatgcactcccgattgctttattttctagtgctgtcggtatattcgggcttgcatttgcgccttcctttgccaccatattgctttgcgttgtctttatcggactcggctctgccattttccatccagagggctctcgtgttgccaatatggcagctggtccaagacgaggacttgcacagtccatctatcaagtaggcggaaatacaggtcaagcctttgctccgctgatcgctgcattaatgctcgtccctctcggtcagtcaggcgtggcttggtttacgattgttggaatgatggctgtcggtttccttctttatatttcaagatggtacgcaggaagacttcaaaccattcgagctcaagcgaaaaaagctccagcaaaagctgcaagatccgaacttcaccgcaagtcagcactcacagcacttggcattatcgtctttctcatctttgcccgctcttggtatggaaatgcgatatcgaatttctatgcgttttatgcgattgaacaatatggattgacgattaaagaatcacagacttatattttcttatttctcattctaggtgcaattgggacatttttaggcgggccgcttgcagaccgcttcggcaagaaaactgtgattttaatttccttattggcatcctttccacttgccttgctgctgccatttgccggacctgtttttgcttatgttttacttggattaattggggttattctgacatcaagcttctctgtcacagtcgtttatgctcaagaactatttcccgggaaaattggcacaatgtctggtttaacggttgggcttgcgtttggtatgggtgcaatcggatcggtcgctctaggctcattcattgatgccttcggtttaacacctaccatgatcggagtcgcttttttaccgatattaggcatcctggccttcttactacctagtgatcaaaccatctccaaatggaatgaatcataaaaaggaaaaaaccgctcagtgattgagcggttttttcatatctcataaaaatgcgtatcaggaacgtgcttctttgcaataaacccttgctgaaattctggaaagaccttttgcacctgtttaattttttgatgaattaaatcagcatacggaatatagagatgatccactaaattttgttctgtcatatagtaataccaattcagattaaaggtattctcatcaatgatcgtaaaggcagaaaaatgatagaacaagagtggacattcgtcgagatacatatccccttttacaacggaaagcttgtagttttcaatattccaaatcgcggcattggctccttttgaggtcacgacatggaccccttcaaaatcatcgatccatctttcaacataccgctgatctccatacgtcttattttttgtatccatttcgactgtacagtgtgcaagacagttttccttccattgtgtgatcgcctgtttggcaacgtctgtgttgcggcagccgacaaatccagtattaaagcggccggacaactcataaaagtgatagaaccgctcagaattcatatgatccgtcaaaaataaatgagcaaggggattctcagcaaaaatcgcctctggatcatgataaaaatacaaatccgtatccaaatgggcgagataatctgcttctgaggattcaaagattttgagcagaaaagctggctttaacgtccagcaatactcatggaacgtccgatcaccctttgcctttcgcagcttggcatcttcaatatcttcaagttgttcatattgaacgtgcggatgaggaaattcacttaacaccttgtaagccaaagggtctgcacataaaaccgacagcttgaatgaatgagcggtttgttcaagcgaatgaatgagcgccaaaagcttaaaaacatgggtattcgacacaatggttgtaaaatgataagacgccatctacaacacatccacttgaaacaaatcaacgcgtaatagctctttcgtcagcccctgaatggcttctacaagcactgtgcagccatattcgtgccgtgcaagctgcgctgcctctgacagctttttcaaagagacatgtctagcggttagctgatctttattatcgcgtttgacgcccacattccgctctgtgatcaaatgaagcagctctaaaaaataagagagcagaccatcgaatactggattttcacgcagctgccgaacctcttttacaatgtcatttgtgacggtgtgtgaaaacggaccagagaaagccagatggacatctatggcatcaatattgttgtacttctcgcacatatacaaaatgttatatttgatgtcatcaaatgaagttaaattacttggatgttcctgatgcacgctcatgatatcctcccgcaattcaaaggagagaccaagctgatgcagacgaatgcctaaatcataatcttcaaacccgtaccgaacgatatgttcatcaaacatcccgagcgcgatgacatgcttgcgtttgacagaggagttattcgtaataaaaaatcgccacggcagctcataagagcctaaatcataattgtacgtgcgcaaaatgtctttgagaatatcaataaactcagactgcaaatcaaagcttttctctagaaatgcaccattctccacttcttgcatggataaaagaggcgttttatctttcattttccgctcatacaagccttgttttttcaatcgcttgatatgatccttatcaaatgcttcgtaaaaataacgataaatccgcttccagcatacaccacaaatgacaaggtcctcttgatcagcatgtgcctccgcatgcttttgaataaattgcggctctgccagcatatcgctgtcatggaatatcagcaggtctccctccgcctcgcgaatggcatgattgcgacccttggcaatcccttgattcacaggaatacgtacctttttaaatgggaaattcacctcaatgttctccagcatttccatcgtgccgtccgttgacccattatcggcgacaatgacctcaaacggaatatccgtatcctgaagcgttaaggaaaaaagactcccttctaaacgctccttagcgttatagctcggaataatgacgcttacctttggcttttcattcatgcgccatcctcctccaatttggcatagccgttaaacagcggatcgatctgctcaacagattcaatcacatggcgcagcacgtttcgataggcttcttggaaaaacggcagatcatctctccccttctcatggatttgctgcatctcatccttgctcacgatgcgaaagccgctgaaatgatagcaaatgagcggatgcccatcatccagcaaaatccgtccattttcttcccgataagaatgctgcccatagttccaatgaccaatattcacgccttttgtttgaatatcttccactttttcaaacagcttcggcatatgatcgagatatccttgatcgccaaacttgccttcgcccggcgcatttttgcattccttcaagcattcttccttccaccaactgaggcattttcggccagcttcatctcctttaaaatgcaggaagcctgagttatagcggcctaaaagcttctgaagcatcttcacttcctcaggatcgaagctcggaatcacaatatcccctctcgaaagtaaaacagaggcatccggctgatgttgaaaaatcacttgcgggctctcataaaagaacaaatccgcatcaaggtaggttacgccctctgcctgctcctgttcaaataaccactcaatccacatcggctttaacgtccagcaatattcagaggcatcccgttcctcttttttctccagcagctccggggtttcgagctcccgtacatgaacgagatcgacatgaggaaaattcatttgatgaagcagatcaaatgcagcatcatccatacataacgtcttgatgacagcatcatcttctacttgcttcaatgataagaaaaacgcaatggcttgataaagccttccacttgatagaaccgtacaatatatgctgttcatctacttacacctctatttttgaaagaattcgcggtaccattcaatcgtcttctctaacccttcatcaatggagtagtcgggcttccaatcaagcagctttctcgccttttctgccgacaaatattgatgctttatctcatgcgttccttggtttaaaatacgaggcttcagttcactgcccattgcctttaaaatcttatccacgagttcaagcaccgtcagctgaatttcattactaaagttaaatgcttctccagcgagccctttttcctccatcttctcagctagcagcaaataagctttaactgcatcttcaatgtagaaataatcacgaataaaagtcccatcacttctaatttcaggcgcttctccttccagcacaagctggatggtttgcggaatgattctgttgaaatttaaatccccgcctccgtataaattgccgcagcgtgtaatacaaactggaagaccatatgtgttgtaatacgtgtgagaaattaaatctgcacagctctttgatacgtcgtacggatgtttcccatttagcggcatgccttcatcgtatggaagctgctcctgatcgccgtatgctttatcacttgatgccacgatgactcgtttgatcagcggctgtcttctgcaagcctccagcacattccatgtccctaaaatattcgcttcaaatgtagaaacagggtgtctatttgcaaccccaacaatggcctgcgccgccaaatggaagacagtatcaatttcatattctcctaacgcacgttcaatcgtttgcatatcctctagtgcaccttgcaccacattcatcttttcaaattgactgccttgatataaattcgaccttggcacctgatcacgcacaagtccagttacgtttgccccttgatcaatcaattccttgacgagatagcttcccaatagtcctgtacatccagtcacaaatacatttttcccattccaaaatccgctcatgccgtcaccaaaccttccatggttgttttccatttgtccacatgccattgatttccttcaggttcttgtacgtatcgatcgctgtccaaaatccgtgatgctcataaaccgcaagctctccatcattcgccaaattttgaagaggctccgcttcaaacacacattggtcatcgtcagtcaaatagtcaaatacctttggagacaacacaaaaaatcctccattgatcatcccgatactgtctgtcttctcagagaaggattgtgccatcccgttatttaccttcaacgtcccatactgtgacttcttttcaattcctgtgacagtcgcagctgccccaagctcctgatgacgcttcagcagatgaaacatattaatattggcaagtccatcaccatacgtcatcatgaatgtctcatccccaatgtagtcctgtgcctgctttaaccgtccgcctgtcatcgtattctcacccgtatctaaaaaggtaattttccagttctctgactttcctaagagcttcatgtcccctgtcgccatatccagcttcatgctgtgatgccgccagtcatagttcaggaaatactctttgatcttctctcctttatatccaagcaataagataaactcatctactccgtaatactgatagattttcataatatgccatagaataggccgatcgccgatcatagcaagtggtttaggaagcgcttgtgtgacctcactcattctcgttccctttcctccgcagagaatgactgctttcatcttctcccctcatctctctatgaaaatttttgattgaaaaccttatctttatgcggaaaatcagtacatgtaccctcatactttgtccgacatcaggttttgaatctactctattcatatgtcgaaatgagagagggtgccacctagcatttaactatttttacaaataaaaaagagcgagatttgtattctcgctctttcaaagtttaaattgtatattatcagggtagatggtatgataaacatgtgcatcaacagcacaaacagcctctttttattaagagactactagatgaaatgaattcaagtggcagcttgcttcattctcaatatgaatcacggaggtgaattcccatggcacaaaacgtactttgtgaagtgaactcttgccgtttttgggctgataacagctgtacggcttctaccattaaaattggtaaaaacacaatgactgatgtgactcgcaatgctgaaactgattgcgaaacatttgaaacaaaataagtggtttttctgagatgaaggaactggcaggttccttcttttcttttatcattctatcaagaatgataattattatcaagtgtttttcactaaacatttctcgggaaataatgacacgatatttctccattcgttgacgattttcactcctttttctatactcaacatatccgaagaagaaaaagtggtgaccaatcaatggattttacgatacgttttctatcattctttgtcgtagaaatcgaaggcaaagatgaacaagcaaataaacggttcaagcattatcaaacattagatcaagaggaatttgaacaaagtgagctgaaggactttttagatggtgagctaaaaaaaatcgtcaaacgaaaagtggacagacaccctaaatctgaacaagtaccaaccaaaattggccgattcattgtcgaacctggtcatgagctcgattcaaatccaaactacaatttatttcatcagacgagatttgccgatacaaaagaagtatttaacgaatgcagtgaacagtttgttcgcacgtatttagatacaagtgctgtcagaggcggcgtttttttagttgcgtctgccgttcctaaaaagtacttcgatgactcctttgtctttattatgaaatgcgattttgaacagaaagtcgcttctatcgctgatacatctaccttgatcaaaaaagtagaaatggcgattacgacaaaaaatatgaaatcgattcaatacccgtttatgccagaagagggcatgacagaggaagctgaagtgaaaattcaccaatcctcacacgctcgttattttgaggactttctgaaattcgtcgaatacggagaatctatgcctgaaatcatgaaatcccaggtcatgaacatggtgcaggaacaagtatttgaaacattacaggatgaaagtgaagaattaaagcagttcgaagaggatcttgaaatatgggaagcgagtgaaaagcgagaaattagagaaacactcgatacagaacaggtcacactagcagcttctcacattgtggaacaaacccctgacatcacaatgaaaatgcgtctaggtgaaacagaaatcaaaggacttttagccgactttggccactcgatccatattgcaaaggtcaacaatcgatatgtcgtgctcgttgaagcagaccaaatcgtctttgaaaaaggaagcacgcctgttgaattccataaaccaaatgggttaaaagaggttgtcagccagctcacgcaaaaagcctacgattcagacttagaataagagaatatgactgcctcctgcgatcagctgcatgaggcagttttttatatagcgctttatttttttacgctgcactagaagaaacatgctgcccgcctcttacccacatgctgacaagcatgaagcttatgacgagcatcagccaaaagacgctgtttgttccgaaaaactgaatcaatgtatacccgcacaaaggtcctaaagcagctcccatatcttgaacaaaagaatagctggcgagaaagcggttcttatctgtttgagcagaggctttttgaaaggcaagtgtatcggtgaacgttgtgacaatcgttgccagcagctgaagcaaaagcagcatcaataggaaccagccgcttaccttcagcatgaccccaagaaaactgagccctccaaataaaagaaacatccagcatagcattcgttccttcatcacaagccgatcaaaccatttacccgttctcggtgcgacaaagggttcccatccccacctgattgcttgaatcacaccgcttaatgccgaagctccgatgacaaagccaaacagagtcaattgattttggtcgatctttgcttcaatgacatgactcagcgtggatgcgaataaaccttggatgatcagtgcgatcagcatgcctgttatcagtactttaaccacatctcgtgtaaaccacttctgtttgatgccctgatacacctgcatgccttctctcttttcaatttcatccaacgatacataaaaaatgcaccccatcaatgtgagtaaaccaaagactagcgtcatggactggaagccgatcaagctggcaaagattccgccacataacatgccaaataaactgccgagccggtaaagcccattataaagccccgtcaaatgcccttgtgtgccttcgtccatttcagccaaaaccctcatcccgctcattcggagtaatgtccaagcgagcccccatgcgcagcggcagatcaatagcagccaaaagccgctcatcccatataatatcgtggtcactgacgcgatcaaaatcgcgatcaatacgcctgtcttcattgggatatatcgatagagccaccatacgacaggtgctagcgggatacgaatgaatcggttaatggacagcagtaacccgacctcccaaatggatgataaaccaatctctttccaatagaccgggagaacaatatagagcattgaatccccaataagtgcaaatgctgtgatgagcgatattgacacaacttgcttttgacgacgatccattttttcttcccccttcgctacctttacgataagggatgccttataataaatctaatgaatgtttttgattgttttatcaaaataattgataggtggtgcaaagttgaatttacatgcccttcggatttttgcaaaggtcgcagagacaaaaagcgtcacacaaactgcagatgcactatctttaacacagccagctgtgacggctcagcttagaagcattgaacgagagatcggatttcgccttattaaacgaaacggccgaggcattgcactcacagaaatgggaaagatgctgcaaccttatgcccggcaagtgtttgaggctgaaaaggaagtagaatatcagatcacgctattacaaaacgggaagaaggggcgcctccgcatcgcttctacctacgtaccactcaactttttactgcctgattggctggctgcatttaaaacgtcagctccacagacagaaattgaattaaaaagcggaaactccgctcaagtgatagagagcctgcttcaatacaaatcagatgtcgccatcgctgtaattgaagatttgcatcatgaggaaattattacctctcatttgacgaatttaaactatgatttcattgtgccagcagaccatccgttgaacggaaaaaccgttctgctagagcgcctgagtctagagccttttttgatgcgtgaagaaggcagctccacaagagataagctcttttccctgttcacctcgaaaggaattaaaaagccgactgttgatttacaattcagcggtgttcatgaagcgattcaaatgatcaaagctggctatggaatcacgcttgttccccgtgatgcggttcagggcagtctcaagcggaaagagattgggcgagtatatatcgaaggcatagaaatcgtcagacctgttgtgatctgcaaacgggtgaatgaccttgaagaaaatagaaccgttgatgccttcctgcaaatgaagggtatcggtccatttaaggagccggctgcaaattaaaaaagtgcctgtatgagaaacaggcactttttctattctgctggctgcacgatgtcatacggtacagcctttgaggctctcactaattgttctggtgtgatcagtatttcatttccccattcacctgctccaactcctaatatttcttcctctaatagcgaagcttcgatgatggtgcggaaaccttctggctgccagcaaaacggcggtattgaaccaattcggtagcctgtcacttctagaaccttctctggtgatgccattttaatattgcgggagccagccgctttctttagtttccccgacttaatatgctggtctgcgccaaccatcacaagcagctgctccccttcccctgtttcaaaaatcaatgtcttaatcatttgtctttcacgaaaaccaagggctgctgctacatttgctgctcccttctctgtttcagaagaaaatgttttgatctcatatgggatgctgttctgattcaagtattcatgtgctggcagaactttcattgatttgaacccctttccttacgatgtctttcatttagcttatcacaatcctctcatccttaagatgtatttttcaatggaaagcctctgagtcgttcttcaccatgctatactgaacttgtttttggaaaggagccggttggatatgggaaatcagttttggtactatacaggcagtaaaagccttctcatgctaagtgatattctatttgtcatgacgatcacatttgtgatctatcaagatacacaatctgttgcgtatgcggctttatttccgctaataagaacgctatgccagctattagctgggctcctctctcctgtgttggcagatcactttcaagcaggccggcttttgaaatgggtcccgcttttacgtcttgggatgcttatcgtctttacagcccaatttcatttctttcagcagcatatggtttggctatttgttgcactcattctcatttccatcacaggcggattcattagtcctttattacaggccatcatgccgatgcttgtgccagaaaatcagcttgtgaaagcaaacagtacagcttccatttttcaacaaacggttcaaattgccggctattcgtttactggaatgctcgttctgttcattggtcccttttatttaatgtggatcacttgtttgatgatagtgttatcttatttgtttttcttccctatatttcctcttcttcagcaagaagaacccgttcgaaaagtaaataaaatgaacagtttcaaggatggctggacgatcatttggacaaacaaaaccattcgtaccctgacctttatggatgtgtgtgaaaatatagcaggcgctgtgtggatcggggcgattacgcttgcctttgtcacacaagatttaaacaaaagtgaagattggtgggggtttatcaatgccgcttattataccggcgccattctaggcgggcttttggcggcgtggataagccgattcattcaaaagcagcttcttctctgtatggcagctggttcattcatttatgcagtgctgaccattgtctactcactgaacagcctgccgtggcttgctttgctgctttgtattttaatggggcctgcctatcaaattcgggatgtttcgcagcagactattcttcaaacggaaacgccagtccgagatttatcaaaggtgtactcggctcattacgtcctttcctctgtatctgtcggtttatctattttctttgttggattgattgcagatgcattcggagcgaggactgtgtatttgctgggcggtttgtttgtgctcatctgttccgggattgccatcctctcttttatgaggcagaaaaaaaagagcggctgattcatgcagcggctcttttacttttcctttaacattgcgaacatatcacgcgccatcgcttctaaaatatacacaacgggcgtctgtgtcgtaatattggctctgtgaacccgttcgtctgtcacgtaataagcaatgtttaaatcggaaatgcgtgaaatcgtgcagtgctgattgtttgtaatactaatgattttgcttccttctctttttaacttcgaaatatgatcaatcgtaatactgttctcccctgatacagacagcacaatggtgacactattgtctaaatactgcatattcatcgggaaaaacggatcattgatgtaaaatgaaaatttctcaagacttgaaaagtacctcgccccatactgcgccaaaataccagagctgcccgtgccaataaacagcacatttttcgcatcggcaatgagccctgctgcctctttaatcttcccttcaaagtccccttttagtgtacgttcaataaattcatatagaaagtgctgggtgctttttaaagtaggtgtccgctctgattctaaatacattttgagtttcactttaaactctgaaaaaccttcacaattcacttttcgacaaaagcgaaggacagacgaggtggagatatgggcagcatctgctaagtcccgaattctcatatacacgaccttttcactgttttccatgatgtatcggtataaagcgctttctagttcattaaagctggaaatgacctcacttgaaaacatctgacttcccctttctccaacagcatgtcacaatgtgtttcttttatgtaacaaatctctaaatagggcacccttgcctaaagacgctgaagtcatttacgcacgagatgctctcacgataagctatagatgtacaaacaaaagaattggcttttctctattataacattgcgcgttacattattcggaggtgcagcacatggcaaaaggattaaaggttgtcacaattggcggaggatcaagctatacaccagagcttgtagaaggatttattaaacggtacgatgaatttccgattagcgagctttggcttgtcgatattgaagcaggaaaagaaaagcttgaaatcgtcggagatcttgccaaacgaatggtgaaaaaagcaggacttccaatcgaggttcatttaacattagatcgccgaaaagcgcttgcgggcgctgatttcgtcacaacacaattccgtgtcggtcttcttgaagcacgtatgaaggatgaacgcattcctttaaaatatgatgtcattggtcaagaaacgaatggtccaggaggtctattcaaaggacttcgtaccattccagtgattctagatattgtcaaagatattgaagaactatgcccagatgcatggcttgtgaatttcaccaacccagctggtatggtcacagaagctgttcttcgctattcaaatcatcgcaaagtcgtgggattatgcaacgtgccaatcggcattcgcatgggcattgccaaaggacttgatgtcgacgcaagcagagtcgaggtcagctttgctggattaaaccatatggtcttcggactcaacgtattcttagatggtaaaagcattatggatcaagtcatcgaagacatggcagatccaaactctacgatgtcgatgaacaacattcaagccattccgtgggatgctgatttcttaaaagggcttggcgtgattccttgtccatatcaccgctactactacaaaacaagtgatatgctggctgaagagaagaaagcagcagagaatgaaggaactcgtgcagaagtcgttcgtgcactagaaaatgacctattcgagctttacaaagaccctgatcttgatattaagccgccacagcttgaaaaaagaggcggtgcttactacagtgatgctgcgtgtaacttgatcgcatcgatttataacgacaagcatgatattcagcctgtaaacacgatcaacaatggtgccatcagtgacattccaaatgattctgctgtagaactgaactgtgtcatcacaaaagacggtcctaaaccaatcgctgttggcgaaatgccagtcgcagtcaaaggactgatttctcaaattaaatcctttgaacgtgttgccgctgaagcagccgtgacaggagattacaacacagcacttgtcgcaatgacgatcaacccactcgtcccatcagatgccattgcaaaaagcatcctagatgagatgctagaagcacacaaagattatttaccacaattcttcaataaagtagaagcataaaacagaaccgcacttgtcaaagtgcggttttcttatttctctgtaaacagctggtccatctgagggcgatcatagtctaatagccagtgctgcaagccctcatagactggccgaagacgctcagcatctgccgcaataagatcacagcctcgatcatcatataagtggaaaatcatctgttttgagagattgataagataaatttcataaccaagcttcccgttcaaaatttgattcggtgcataaaagtcctcttggcatatggcttgtagaagtgggcgtaatcggatatcttgcagcttgcaagtcagtgtaaatctctccaatgtcaggggctcatctagatctgatctgacataggtcaaaagctcgtgacgcaatcgattgcgtacttgccggcgaacatatttctgataaactaggagcttttgcttcgttaattcatgttcatgctgcgtatagacatccgtgacaaatagaatatcgtcttctggatcaaaagcatatctgacaattttcaaagcacgatcccctgctttttctaatacaactgatttttctcctaatgaccaatctgccacttcaaagcgaagcccaaaaggccattcataaaaaagaggcggcgtgaggacaagattaggaaaatgcctttttaaaaaactattcgtttgatcgctcatgtcatgtccttccattggttttatttcttattttaccgttgaaactgatggaaataaaattgggaataaactgtcatttcttatatgatagaaagagatggaggtgtgaccaattgaaaaaatggtttttacaggtgttcctcaccgcattgatcactatgtggatacaggctggacttgatcaagtgaacatcattcatatcaccaatgtatggatcgatgccagcagctggatcctgatcttctttgttatctacgcactttttgaatggacagctcacgtcttagcaaaaaggaaaactgctcatcgctgaacatctcttttcatagagatgttttttgttgaaattcttcctgcacaagctcatgaatcacgcccattcctgcctggcttccagcagctgcggcaagaacaagttgagctggcccgcctaaattgtcaccgcatgcaaagacaccgctgacggttgtacgtccaagaatatctgtttcgataccgccatttttcgtcatttgacagcctagtttttcagcaaatggagctgactgcttgaattcacttgcgacaaatccgccttctctcttcaccgtttccccatttgcaaggtgaatagagtgcatttgcccattctcatgatgaatggacataatcggtacatcaattacttggataaaatgtgctgatagcaacgccttctcctcttcagcaaacacttgctgtccattcgtaaacacgatcaaatcctttgtccaattggaaagaagtttagccatatgcaaggcgcgtggattctcagcaatgagagcaagcggcttgtcctttagctcccagccatcacagaaaggacagctaaacaacgtctttccatacacttcatgaatccccttcatctctggcagtatatcctttagtcctgttgccaatatgattttcttcgcttcaaatctttctccctcttgtgtcagtaacgcaaagttgtcctcattgttttgtatctcaacaattctagttcgtttgatttggatattggagtagttttgaagatctgcttcacccgcttgtctgatctcaaacggtgtcatcccatcgtttgtaataaacccatgtgattcctgagtcactcgatttcttggcatcttgtcatcgaatacaatgacctgttttctgccccgccccacaacaagtgctgcacttaatccagctggtccgcctccaataatggcacaatctaatagcatataaatctctcctttttattcaagactttaaagactcttaatatctataattcattcaaaaaaaatcacatcttgaaaaatggatttttttctgtctgctcaatttggctagcgatatcaactaaccgcttttgactaagcgtttcctgcattttcatttcaacatcctgcatggcttgttcaatcaaacaaccatcatgaggcatgaaagaatcatgttctaaagaacaacgaaataaattggtttgaccttctaccgcttgaatgacgtctaaaaatgaaatgtcctctttctttttcagaatggtgtaaccaccttttgcgccaggtgttgattcaatcaatcctgccttcacaagctttgttaaaattttggataaataagtggatgaaaggtcttgcatcttggcgagaggctcaacgccaattgctttcccctttggtgcaagcgttaaaaataccatcgtatgaagcgcataattggttgctttagaatatttcatcagacgattccctttctatctattatagaccttttatatctgtaattgatcataaaagattcaagaagaaaaagcaagtcttgtggatctgcttcttttttcattccacatttcgcatttctttccgataatagaggtaagcacgaatcaaatttgatgaaaactagaaggagtgaacaaaatgtcagatcaacagcacaatgcagcacacgaagaagaagaggaatttaacgtatatgatatgcttccacccgcaggaacaatcattggtgaagcaacggaagaagaaatggaagctgcggcagcattagaagtgagacattacgcctttatgcgtcttcaagactcgtacattcaatttgacggatcttcctataaagaattgctcaaagactttcaagaactagaatttgattctgcaaagttttggagagccatcgcacgacgcctgcaagtcccatacgaatggcccatccgaatcgaccacgcaaacggtcctatttatattggcgaaacagaggatagccgtgaggttgaggagagtgcggagtaaaggaaatgtgaccccctttttgaaaaagggggcttttcgtctccttcacaatccatcgattgaaaaaacaaataagcaatatgagcattgtaacgcccatattgcttattctcgtgttatgttaactctggccaaaaggcttgatttgccacaattaagtcatctagaatatcttttgctactttagcactcggcaccgttttcgataatgtaatagcctgccatagtttttgataggacccttcttcaaatgcttctactactaatttttctacgccaacttgctgctccatgagacttttttgaaatctaggaatttctccaaccactaacttttctggaccgttgctgccaacgatacaaggaatttcgaccatagctgttgggtcaaagttcctgattgcgccattgttctccacaatcatcagcatccgttcctttttattaaaagcaatggctcttgctaaatcaacgatataggaagcgtgctcatcaatggctagctttgtttcctttgcagtacctttatcaatgatggcctgacattcactaaaaacaaaggcttcccgtccctccatcacttcattggcacgtgtgaactctatatttgaatgtgccacttcttcatctggaaatagatagtatttcaaatacgtatttggtaccgtttttggatcaagtgcttgaatatctttagccttttttaatgtgctgttccagctcttctgctgttctagttcagatgttccatctgctgcataaccatgctggcttacatgctgaatgacctcaggcattaagctatttccttttttatctcgaatatctgtccaccagccaaaatgattcaaaccataataatctacttccagttctttacgtgaagataagcctaaattctttgcaatcaattcttcaattccaatcggcatatcgcatatgtttaaaattttggcattcggccttagcttacgtgttgcctctgctactattgctgcagggttagaatagttcaacatccaagcttcaggagagtatttttccatataatcgacaagttctaatacacctggaatggaccgcataccgtaagcgattccccctggaccgcatgtttcctgcccaacgactccatgcttcaatggaattttctcatctaattcacgcattgcatatttgccgacacggatatgtgccatcacaaaatcgacttgagtaaaggcttcttctgggtcagtacttgccagcagtcgaacttctggcgctcgttcttttaacataatctcacaagcatctgcaattgtattttgtctagtttcatcattatcataaagtttaattgtatgaattgggaactcatctaaatagtctaacagcatcaaaatgattcccggtgtaaatgtacttccgcctccagcgatcgtaatattaaatgttttcatgatatccagctcctttttcaatctaatgaaagttttgtttcaaaggactctctcacttgcggtacacttaagccaacgatgatttgaatgctttgaccactcttagccattccatgtgccagtttattttttgtaaagtattctctatctttcaccaagctagggtcaatcactgtaatacgcagacgcgtggcacagtttgttacatctttaatgttttctttaccgccaaggccttctaagaaataaacggctttctcttcgtactcagacgcataaacgggcacttcctttttgttatgatcctttttattagcattctcataatcttgttttgtatatagcctcgtctcctcctcatgttttcgtcctggtaatggaatatcaaatttcacaatcacccatctaaatatgacaaaatacaatgctgtaaatagacatccaattgtggcttggatcagataaatccctccatgatttgaagagagcggaatccagttcaaagcagctatttcaataagcccggaacccatcattccgacaacaccaaacatattcatgattgtcaccatggttgctccaagaagtgcatgtatgacaaataaataaggcgcaagaaataggaatgtaaattcaagtggttctgtaattccggcaaataccgctgttaatgtggcgggtaataccaatgccaaaaccttttttctgttttctttcggggtagaaaaatacatcgctagagctatcccgaaacagccgaacatcttaatatttccatgcagtaaaaatccgtacggataaagatccttcaaatcggaagttgaggtcgcaaattcatttaaatgagcaatccaaaatggttttaaccctccatttacagccgctggaccaaactcaaaaggtgtataaataaaatggtgaagtcctgttggaattaacaccctttccaaaaaatgaaacagccagacaccaatataaccagactgtgccatgaacccttggagagattgaattccctgctgaacataaggccatacaaaagcaacgacaaaagcaataggaatcatcacaaagaatccgatgatgacaacaaagacaagcccctggaaaatcccgagcatttcaggcagcttttgatcataaaaacgattatgaatccaaatcacaattccagatatcatcaccgcaccaatgatacttgtatcgagcgtaggtatacccgcaatttcttttacacccgctacgttctcgactccttgcgataaatcaacaccaaaagtggacggccaaagtgtcaaaatcgcatgaatataattattaaacacaagataaatcatcaaagctgcgagcgtcgcacgtgcttgcgctttttttgcaagtgagatcggcaagccaatcacaaatgccagctccatatgattgaaaatcgtccaccctccactttcaatcagtgtccaagccttataccacatcgtaccttctgcagccatatcccccataatcgctggattcttacataaagtcgcaaggccgacaacaataccaaaaaacgcgaataaaaggactggaactaccatagcactgccaaatcgcttgattgcattcataagcatcacccctttgtttgatccataacaccactgtaaagggagcgcttacaaaaaccaataggattgacgtatttagaaatcaagttgtaacattagattatattttcacaggaagaaaatattttcatgttggagggcacatcccatgatattggacaagctggtaaatgaatacttcgagaatttaaataagaatgacctgcacattattaaaacgattcacgatcatcttgaagaaatgaagacaatgaaaattcaggatcttgctcgttatgctcatacttccatctcctccattcatcgacttgccaaaaaaataggtttcgacggctacagtgacttaaagtcttatgtgaaattaaatcatcttactgaagaatcaacacaggatttaatgaaactactcgatcaagatatcagccagacaaggaaatttatggagcagctggactttcatcaattaaatcaactgattgaccgcgcaccatatatttatatttatggtacaggaactgcacagctcgatttggccaatgatgtacaacggcagctatggtcactgcataagaaatctcaagtattacgaagcaagcgagacttaacagatggaatcattgaatttggtgaggatgaccttttatttatcatttctttatcgggtgaatcgaagaatctagatgaaatcattcaattagtgaaaacgagacatatcaaatttatcagtatgaccacattgagaaataacctccttgcacaaaatgccatgtttaacatctatgtaagcagcaccccgtttcctttgtataacaaagtggacaactcaagctttctaccattttacattgtggtagatatgatcgtcagaaaatttagtgagtggaaatggaatcaattgaataataggacttaaacataataggtacagttttggagagaaatagtgagagaatccatattgcttcacaaaaaaagagagactcttttgtctctctcaaaaaacaacaaaacatttttctgactgcttaatgttattcagcagtataatgcccagcaatcagttcatcaaacgaatccgctaatttgaaatctgtctcatcttctagatcaaagtagtgaatcggcggatgttcctttgtttctctataatctaatgcgatccacgtatgaccatccccacaaatgagcacaagtccctcaggcaattcccattcttctattaaataatcactatccatgatcccttcgcctttggcaattcctcttaaatgatcaaatgacacatgatcctctgcccatccattcggctggtccgttggaaaagcatcgtgcagggtataaccgccattttgttcgaggataagcttcttatatgtatccggcagcgtgacgcctagcttcttttccgcttttgcaatgcctttctcattgattttcttaaatgtctcttcactttctatgtctttatcccaaaatgatttcaaataaaatacctccaattgttatttctatctcattttaccatttggagcaactagttcaatagtcctgttcatagaaaaaagagaagggcttcccctcctctttttcatcatgattattcttgatttctcgcttcaaattcatctagcattgcacgcacttcatctgttgaggatgtgttcattaattggtttcttaggaagctcgctcctctgaatccttttacataaatcttaaagaaacggtgcagtgccttgaatggacgcaagcctagtgatgaatattgatcatgaagatcaagatgcaatcttaaaagacctagcagctcatcactcgtatgttccttcggctctttttcaaaggcaaatgggttatgaaaaatcccgcgcccaatcatcacaccatccactccatactgctcagcgagctttaagcctgtttgacgatcaggaatatcgccattgatcgtcaaaagcgtatcaggtgctacttcatcacgaagttttttgatctcaggaatgagctcccaatgcgcatccacctggctcatttcctttcttgtgcgaagatggatagacaaattcacaatgtcttgctccaaaatgtgtctgagccaatctcgccattcatcgacttcagtaaagccaagtcttgttttgacgctgacaggtaatcccccagcttttgccgcttgaatcagttctgccgcaacgtctggacgaagaattaagccactgcccttcccgttttgcgtgacattcggaacaggacagcccatattaatatcaagcccctgaaatcctaactccgccatcccaatgctcatctgtctaaagttctcaggcttgtctccccaaatatgagcaacaatcggctgctcatcctctgtaaacgttaaacgccctttcacactttgaatcccatcaggatggcaatagctctcactattcgtaaactctgtgaaaaacacatctggtctcgccgcctcactcacaacatgacgaaacacaacatctgtcacttcttccattggtgctaatataaaaaatggccgcggtaaatcacgccagaaatttttactcatctttcatccaattcctctcatgacatagcgccttttaagggcatgtccttctataaagtctttcagcaatttttatcattatatactttagtaaggattcaacgcaaaaggagtataaaatgaacaaaatactatcagcactttataaaatatcaaaaatttgaggagacgtaaacgccgttcaaaaagctacttcaggtaaacatgtcacgcgacgggcagcaggtacagcatccggcaaactaatgaaaagatattcaaataaaaaagccctatgcaggggctctttaaattgtaattgccttttctgttacatgataagtgttagaagtaatgattttatcaagtgaccaaccggcagcgaataacacagaaaaaattgttaaactgataaataactttttcatcataacgcctccgccatttttagtatttgttgttgtgctttaatggtcttttttagatattctctattcaattcaaaattccctttttgataatgataatctgcgagtttatctgataactccgctacatcttgccacaaacttttgctttctaaataactgaggctttcatttacctccgattcattatattcttcaaaaagcgcataaatgatttttaattttatcttgttcgtagaatacccaggacaacatataaagtgttctaattcccgagatcgtttcggcatgttcttttatttgaattgaatttagaaattcattttctgcggtttcaatttctccggctctttttttcactaaacctaaattatgatgtattacaccaataatccgttgggctgtttcctcattaagctcttgagccaagctcaaggcttccctataataagattctgcctcatctaagcggtataagtcgtacatattcgctccaaatttgatattacaaccgactcctttcgctttgtaaaactcgcttgttgaatacatttcttttgctttttccaaatggtttaacgatacgaaatgttgatcaatgcgataatatgcatcagctagtttgtaatgaaattcggctctttctatatcatcgggaacattctttaaatgttcttcagcagccttgtaaaaatttatagcagcaacataatttttttggtggaattcgtgcatacctctaaagaagtttgaatagtagtcaagcgttcctttgacgtggggctgtttgttctctatttctctgagtaaatcgggtaaagtggggcgttgttgattcatttcaataggcacaagactttcaagcatgagtcgatgcctaaactccattaattgataatatagcagtaaatcttgatcctcttccatgtcctctatttctctttcaacctgttcttttaaaatctctgcgtccggcacgctgaatgtccttataaatctataccaatcatttatcaatataccaacttgagaagaaagaattttctccactcctaccatcccctttcttgctattccctataatgacatatattatcattttctaaatatttccacaccgaaaagaaaccgcaatttttccataaaaaaaatacaattatatagacaagcaaatgtataacgttgtgaaaatacagtattaaaatactatttacccttaatttggttgttgttacaatttttatgtaaattaagaaaggagtgattatcttatataaaagtcctataagaatttaagacatatgccactgttttttctcaagatgtattttataattgaggcttgaacaacaagatttttttagcactataaacagcctcttcattaaattttcggaggcgaaattactatgacttttagaaagaagtttgttcctgtactattaagcgcaactttattaacttccggtcttggtgcgactactgcgtttgcagcggagccaactaaatcaatagcaccagtacatacgaaggtatataaaacatctttacaacaagccgcaacaaataacagcactagccctattcagtcaaatgctttaacaactcaaaaagccacaaacggggaagtttctactcaaggtgctgtttcatggtcatataaagcattccgaggtgctttacgttctggtggatggttactatcaaaagcattgaaaccctttaatccaaaggctgctgcttggatcagaaagaaatcttctaaaatcgcaaaggtaatggataaaggggaaaagtggacagaaaaacagtttgtaacagcttttattaaaatgggtgcacctaaagatgttgctaaaactttggcaaaattcatcattactcttatttaaataaacaataagtgctattagttttctaatagcgcttttttatggagggtatatatattgtctttttcttatgtgatttcattgacttttttaatacttcttttagtttctatcatattttatacttttttaaggaaaaaaaatgttgtagatgaacccccaggtgctattgctgccgttcttcttattttactaatatgtttttcccttggtttcgttattgctattccgactttcatgctttacctagtatcattgggagtaaattttcttttcggcgaatacataacttatgattcatttttctctttggtgaccttttctttgttagttagcatcatcgtaattttttggtcatttatagttttatttatagggaaaggaatcatttttttgttgaaggtcccaaaatggataacttatattttagaattttttgcttcgtgggctcttatttacttttcaattaaatatgtactaaatatggagatagttgaagtttctatatggggaaatggtgtattgattttatctttctttgttagctttttatacattggtcttgatattatatcctctgcgcttgatcaaaaaaatcaaaatatagaagaagaaccccctatccaataatggaaaagggggtttatttggttcatagcttttactactatagtcatatgtctatagatttttatttaaataacttttctaacactgctttagtctttggaccatagatgtgtaattcattatccggatacattggcttgataaagtttatattattcatctgtgttccagcacagcaaggaaatcagcaccaccgcaaactccttgttctatccattgcttaaatgaaatagctagcgtttgtattccggaagcaatgcccccattaaatttcaccttattttctttaaaatccaaaatgtagattaaatttcccatcaaacctcacaatatcttcctttatgaatttgaatgacttaataatgaaatttaaaaattaagggaccaaataggatttaccagatatcctcacttgttatttatgtgccaaaatattaaacctctctgaaccctcccctcattttttcccttttacagtttaaaacacctattttcgatcacgatgttttgttaacgctttttcaaagtgataataaatttatcctatgatggtagaggaactataagagaaaagagaagtttatttcagttagacaatttaagggataaagacgccacgcactccacatgactcgtatgcggaaacatatccacaggctgtacttcctccgtcacatacccaccatcttcaagaatacgcaaatcacgagctagcgtccccggattacaggacacatacacaactcggtttggtttcatctttaaaatggtgtcaagcagtgcttcatcacagccttttcttggcggatcgacaactagcgtatctgctttgatgccttctttgtaccagcttgggatgacggtttctgcttcgccgaccgcgaattcgacgttgttgatcccgtttaaggcggcgttacgttttgcatcttcaattgcttctggcacaatttctacgccatatactctgcctgctttttgtgctagaaataaggaaatcgtaccgattccacaatacgcatcgatgacggtttcttcgccttgcagcttggcatattcaagggctttgtcgtaaagcaccttagtttgggctgggttcacttgataaaatgagcgggctgaaatggcaaatttgatgtcgccaatcgtgtcataaatgtattcttctccccataaaacggttgtttcatctccgaaaatgacatttgtcttcttcgaattcacgttttgcacaattgaccgaatgtgtgggaagcgtgctataatctggtcaatcacttgctgcttttgcggaaagtcagccgttctagtgacaaacacaaccatcatttcacctgttgcaatcccgtagcgaaccatcacatgacgcagccagcctttgtgccgctcttcgttatatgctttgatgccaaacgcattgcatatgtcttttactgcctgtaccacttcgtcattttctgactgctggatcagacatttttccatatcaatgatttcatgggtacgctgctgataaaatcctgcaacaagtccgccttcgcgttcgccaactggaacttgtgctttgtttcggtaattccaagggtcttccatgccgagtacaggatgaacttttacacggctcatatcaagcttgccgatccgctctaaaacgtcctttacttgtttctgtttaaatagcagctggccttcatagctcatatgctgaatttgacagcctccgcactgcttataaatgggacatggcgcatcttgcctgtgctgactttcctttgtcagctccatgagtcgcccaaaagcaaatccttttttcacacgtgtgaccttgattttcccttgttcgtctggaagggcattcggtacaaagacagggaatccttcaattttcgctacacctgcaccttcgtgcgttaagtcttcgaaggttacattgtagtattcattcttttcaacaggcggtttcattttcaccaattttatcacctcatttgcaaagaaaaacttggcgccataaggaaccaagttcaatctctaccctattttttcagctgttgcttttggcacaataaattctatatgacgatacaggttttcaaattcacctggcagcatgccgccgaattcgccatctaaatttaattgcattttatcttttacatctaccttcacgcgattcgcttttgcgtagatgacattgttatcatgaatatgctcgcctcgaagtgcaaggctgactactcgaatggcttctgctaaattgaccttctttaaaataatcaggtcaaacattccatcatctaaaatggaatctggcgctagcttttcaaagccgcctactgaatttgtgagtgaaacaagaaacagcatgatttctccatgaaacaacttaccgtcatattcaatttcgacttctgtcgggcggatcgaaggaagcatctccatgccttttaaataatacgcaagctgtccaagcattgtcttcagcttactaggcacttcataagtgagctctgttaaccggccgcctcctgcaatattaataaaataatgtccattgactttaccgatatcaagcggcttcgctacaccttctataatggcatctgttgcttttaaaacaccttctcgtggaatgccaagtgctcttgcgaagtcatttgttgttccaacgggaataattcctagttttggtcttttttcaagcggggctagtccgttgacaacttcattgatcgtgccgtctccacctgctgctacaattaaatcaaagtctcgctgtgcggcattctcagctgcttgtgtcgcatctcctgcacatgtcgttgcatgacaagatgtttcatagccagcttgttcaaatttttgcaaaacctgcggcaaattcttcttgaagagttcacgcccagatgtcggattgtatataattcgagcacgtttcattcatcatcatcctatattcattatgcaatctattttcaccactaacaacctttaattatactatgagatttgaaaatggcaacagaacaaccacctaatattagaaatctcctgccacatttccctcagcaagaaagcattctgataagataaaagaaaacgctgtaaaggatggtttgcgatgaaaaagcctgtctattttaatcatgatggtggtgttgatgatctcgtctcattatttcttctccttcaaatggaacacctgaaagtgatcgggacgtctgtcatacctgctgattgttatttagagccagctctcagtgcgtctcaaaaaattatcgatcgatttagcccttatgaaattgaagtcgctgcttcaaattctagaggcgtcaatccttttccgaaagagtggcgcatgcatgctttttatgtagacgccttacctcttttaaacgagaaaggcactgttgatacaaacgtatccaagcttccagcacaccttcatttaattgaaaccgttaaaaaggcagcagaacctgtcacgctgctctttacaggcccgctcacagaccttgctcgggctttagaagaggatccttccatctctaataaaattgaaaaattggtatggatgggcggtacgtttcttgaaaagggaaatgtggaggaacccgagcatgatgggacagcagaatggaatgcattttgggacccttatgctgtcagcaccgtcttcaaggaacgctttcctattgagatggtcgcacttgaaagcacgaatcaagtgccgcttacacttgatgtgcgtcagcgctgggcttcccttcgttctcacattggaattgattttattgggcagtgctatgccttttgtccaccactcattcatcatgaaacgaattcgacgtattacttatgggacgtactcaccacgatgacgcttgcttcttcatcatttacccattcaaaagaagtgaacgcaatcgtttataccgacacgccaaagcaaggacgtaccgaagaacattcagatggaaagtcaatacaagtcattgaccatgtcgatcgtgatgcctttttccatgcatttgaagagctcatgagaaaagctgtttgtcagatttcaacataaaaaaagccccgccaataaacggggctttcaaatgagtgagaaagggttgaaatgatctttatttcagccctttggcttcctcttattcttcttcagcgtactttttcttacgtctgaacttgcttaaaatttcatacacaattgggacgatgaccaatgtgagaagtgtagaacttgttaaaccgccaatgacggtgacgccaagtccttttgatacgatctggcttccgccttcaaatcctaatgcgagtggcagcagtgcaccaatcgttgcgagtgccgtcattaagattggacgtaatcttattgttcctgcttcaagtaaagcttctcttgttgaaagaccttctttttctttatgaatcactcggtcaatcaagacgatcgcatttgttacaacaattccgatcagcatgagcagtccaatcatggcgtttaagctaatggtttcctttgctaaaaacaatccaacgagcgcgccaataattgtaaatggaagtgagaatagaatcgcaaatggtgcaagacctccgccaaatgtgatgacgagaacgaggtacacaatggcaatcgctgcaagcattgcgagaccaagctgtgtaaaggattcctcaatatccgcacttacgccgcctgtgtcaatcgttacgccagatttcacatcaagcttgtcgactttcttctgaacatcctgcgttacacttgagacgttgtctgttgtcatgtcaccagacacttctgcgtagattttcccatcacgttttgtcactgtatttgctgtcgtaccgtcttttacttttacgacatcaccaattcgaacttcttgtcctgtaggtgttgtgatttttttattttctacatcttttatgctcttatattcgtctttttcggtttgaagcttcacatcaagttctttgccgtcttctgtgactttcgttagtgttgtttcactattttgaggggcaatcgcttgagcgatttgtgaagcagttagacctagcttcgccagtttttcttgatctgcattaaacgtatattcgtcgtatttctcagataagcttgtgctgacattttttaagtttttctcatcttttaagatgttctcgacatcttttactgtgccttcaatatcgcttactttgtcgccgtagacatagtacgttacggtattgcttgcgccagcagacgagaagtcttgtgatttccattcccctttagacgttttgtcttgcagggctttcgtcactttatctttttctttatcaaagtttggcgtgtcatcgtcatattgtacgaagaataacgcaccgttagagttgccccctacacttgctgtcataggatttgaagaacctagtgaatattgaacagtattgacatggtcacgcttgatcaaatattcttctgcttttttcgtttcatcaattgcttgttctctcgtttgtcccggctcaggagtatatgtcaccatcgccgtcttttctacttcctgtggtaagaagctgacaccgacaagtggtgctaagaataagcttccgacaagcataagaatcgcaattcctgatgtaatccatttatggttcagtgtccaattgagtacacgtctataaccgccggcaagcttacttggtttatgctcttttacttttttcgctgtgccatacaggttctttttaaatagactgtgtgccatcattggaacaatcgtaatagcgacaagcagtgacgccattaaagcaaacacaatggttaatgcaaatgggatgaatagttcaccaatcattccgcccactaatgctaacggtaagaatactgcaatagtcacaatcgtcgaagacattatcgggataaacatttcttttgtggcttctctgacgagtgtcttgccttttaacggttcatcctttaacgccattcgtcgatagatattttctatgaccacaatcgagtcatcgaccacacgcccaatggcgacggtcatggcaccaagtgtcatgatatttaatgtgatatccagctgatttaataataaaacagcaatcaacagggataacggaatggagatgaccgaaattaatgttgatttgatatctcgaaggaacaacataatgataatgatcgcaaagattgctccgatgatcgccttgttcagcattgtgctgacagattctttaatcggctctgcttgatcatatgtcgtgctgactttgattcctttattgtcttttttgaatttctcaagctctttcgtcacttcttctgccacactcacagtgttggcatcagaacctttgacaatttgcagaccgatgctgtcttttccattcgttcttgaaatcgattctgcatcttttactactttaatatccgcaatttcagaaagcttgatcgttggcagttctacagattgactgcttgctgcacctccaccagtttgctgctgagctgctgcctgttgctgacttgcatttccagcctgctgctccgaaccttgcgcacctgggttttcagcgccgctagatggtgctccagctccagcgcttcccgcaccgccgcttgcacttggtgtgacagggattcgcatgtttttcaaatctttgacgcttaaaatattgccgtccacgacaactgatttttgcttgttaccaaacgtgtatagacctaatggtacattgacatcagagcctttgatcatgttttgaacggtttcttcatctaaaccgtattctttcaatttcttttgtttaaaagaaaattctacttctttgatttgctgtcctgaagcttcgacagaagagacaccgtctaatccttcaatggaaggaacaaggtcgtcttctactttctgtgtaaggtcttctaatgattctttatcaccagagacactgatcgctaagattggaattgcgttaatgctaaagcgtgcgatttttggtttttctgcattttccggaaaattgatattgctaatcgcatcttcaatttccttctttgcttcatccatgtctttcttgtagtcgtactcgatttgaatagatgaggcattttcaaatgaattggatgtgacaacattgactccgttgaggttttgaatagacttctcaatcgggtcggtcaccttatctgatacttcgtccggcgttgcgccaggatacgttgtagaaaccgtaatgactggagtgttgatattcgggattgattcttgtttcatattcaatccggcatatagaccagcaactgttacgataatcgtcatgagccatacagcgaacttattctttaatacaaaattgatgatcgaattcattatgtcctccattttcctttatgtattgactgactggtcattctatatcataataaacggtgatatacaatgccgtcaaccatttcacttgcgtttgacgtaacattctaaagctgaaggggccttatttcatgaacgaaaaaaaagaaaaaatcattaaagcaagcatccagttgtttgcgaaaaagggtttttcttctacgaccattcaggaaattgcagatgagtgcggaatatcaaaaggcgcattttatttacatttcaaatcaaaagaacagcttttcaatcgcgcctttgaatattatatcgacacgtccatgcaaagtattgaaacgattcgaaaagagaatcagcatctcgcgccgagagagatcttccagaagcaaatcgctgaacagtttcaacattttgctgagaacaaggattttatcattttgatcctcagcgagaacattattccagaaaaccagcaaattaaaaagtattcaaaaactgtgaaaaagcaaatgaatgaggaaatccaaatttccatcttgaccacttatggacaggagatcgaaccatatataactgacctgtcagtcatgattcaaggaatcatccaatcgtatgtgcaggtgctgcttttacaagatcagctgcaattatcatttgatgagctctcttcctttatactcgaacggtttgatgatttggttcaaggcatgcttcgttctcagacgaaaccgatcttaaagccaaccatttgggacgatgaagcgccgagtgctgcttcccttcaagaggagcttcgtttgttaaagcttgagcatttactttctgatgatacccttgtatccattgaagtcattgaggaagaactggcgaaagctgagcctcgtaagccagtcattcaagggatgctgacgaatttagaaaagtgtgaggaccctgctgtcataagagtagtcgaacaattgaagctgtttctttcataactttacgcgctgtttttccgattcgttcacctttatcccccttcgaatgtgcactttcgcttacgcttcattataagaaaagaatccccgaattgatatacggcggtggtctgaatctatgataagaccctgtcagttcaaataaaaaaaccgcctcttctcatgaggcggttttttgctatttagcgttttttgatttcttctaggagaatcttgttgaccatcggcgggtttgcttgtcccttcgatgctttcatgatttgtccgactaagaaaccaatcgcgcggtcttttccatttttaaagtcttcgatggattgcgggttgttatcaagtgcttctgtgacaagtttgagcagggcaccttcgtcagaaatttggacaagtcctttttctttgacgattgtttctgcgtctcccccattttcaatcagctctttgaatacctttttggcaatcttagaagaaatcgttcctttttcgatgagcttaatcatgccagccaggccttgcggcgttagctttgtatcttccagctctttttgagctgagtttaagtaggcagatacttcacccatcagccagtttgaagcttgcttcgcttctgcaccttctgaaatggttgcttcaaagaaatcagacatttcttttgtcagcgtcagcaccatcgcatcatacgcaggaagccctagatcatcgatgtagcgtttgcggcgctcatctggaagctctgggatcgatgctcttacgcgttctttccactcgtcatcaatgtacagctccactaaatctggttctgggaagtagcggtaatcgtcagaaccctctttgacacgcatgaggatcgtctttttagacgcttcatcatagcggcgagtttcttgttcgatcaagccgccagaaagcaatacttgctcttggcgtttctcttcgaattcaagacctttttggacgaaagcaaatgagttcaagttcttgagctctgttttcgttccaaactcttcacggccgattggacgaagtgaaatgttggcatcacagcgaagcgagccttcttccatcttacagtcagatacgcctgtatattgaataatggattttagtttttctaagtaagcatacgcttcttctggtgtgcgaatgtctggctcagatacgatttcaacaagcggtgtgccttgacggttgaaatcgacaagtgaatatccgtcgcctgtatgcgtcagtttacctgcatcctcttccaaatggagacgcgtaataccgattcgtttcgttttgccttctacttcaatttcaatccagccgttttcaccgatcggtttatcaaattgagaaatttgatacgcctttgggttatcaggatagaagtagtttttacggtcaaattttgtatctgttgcgatctcgcagtttagcgccattgctgctttcattgcaaagttcaccgcttctttgttcaatacaggcagtacaccaggatatccaaggtcgatgacacttgtttgcgtgttggcagctgcaccaaaaggtgtcggcgaactggagaaaatttttgattgtgtttttagctcaacgtggacttcaagtccaattaccgtttcaaagttcattctgattcaccccttacagttcaggttttgctttatgatgatctgttgcttgctcgaaagcgtgagccacgcggtaaaccgttccttcatcaaagtgcttgccaatgatttgcagtcctaacggaagaccgttagcaaatccacaaggcacactgattcctggaacgcctgcaaggttcacagggatcgttaaaatatcgttcgcatacatcgtcagtggatcgcttgtcttttcaccaatcttaaatgcaggagttggtgttgttggtcctacaatgacatcatacttttcaaaaacatcttcgaagtcttttttgatcaatgtacggactttttgcgcctttttatagtatgcatcataatatcctgagctgagagcgaatgtgccaagcatgatgcggcgtttcacttcgtttccaaagccttcagaacgagtatttttatataaatcaattaggttttctgcattatctgtacggtagccataacggatgccgtcaaaacgcgcaaggtttgcagatgcttctgaagaagacagtaagtagtaagtcgcaagcgcatatttagaatgcggaagagacacttcttcccatgttgcaccaagtccttctaatacttttaatgcttgaagaacagactcttttgcttcctcgccaacaccttctccaaggtattcttttggcacagcaattttcatgcctttgatgtctccagttaatgaagaaagaaaatctgggacgtcgacatttgcactcgttgcgtccatttgatcgaccccagcaatcgcttgaagaacatatgcgttgtcctctacgttacgcgttatcggcccgatttgatctaatgaagaagcaaatgcgattaagccgtatctagatacacggccatacgtcggtttcagacccacaacgccgcagaatgatgccggctggcgaatcgaaccgcccgtatctgatccaagtgaaaatggtacttcacctgctgcaacagaagctgctgagccaccacttgatccacctggaacagtgtttaaattccaagggtttttcgttgctttgtagcctgagttctctgtagaagatcccattgcaaattcgtccatatttaatttaccgattgtaactgcttccgcatctcttagacgattgacaaccgttgcatcataaatagggtcaaagttttgcaggattttactagatgctgttgtacgtaaatcctttgtgacgatgttatctttcacaccgattggcataccgaacaatagaccaagctcgtccttttcaccaactgcctcgtccaattcctttgcatacgcacgagctttctcttcgtccagtgcaaggaatgcttgtactttcccgtctacttcattgattcgtttataagactcgtccactaaatcagaaacagacagttcctttttatgtaaaagctcttttaattcagaaattttgtgatcaaacagtgacatgcctcaggcctcctttagtccaaaattgatggcacacgaatatagccgtctttatgatcaggcgcgtttttgataactgcctcaatggaaagacctttattcggaacatcttctctcatgacgtttttcatttttaatacgtgtgttgttggttcaacgttttccgtatctacctcgtttaactgctctgcaaatgaaatgatgctatcaagctgttcagtaaacatctcagcttcttcttctgtaattgcaagccgtgccaaatgcgccacgtgctttacttcttctattgaaattctagacatgcaggttcacctccaaaaatgatacgtgttcgtggtcatgatcataagtcatatacactttatcatatcaaattttactgttctaaagcaactttacacaggcttgagatggtagccattcaccccaaaccagaaagtatgaaaataatttgtatcagaggttgaacatttatcagaaaattttttcttttaaatgtttttggtagcgcttacatatagattctcatcaatcatttacgcttttttttatgtaagaaagaggtttaagaaggttgatcagcagggaatactctgttaggttaagtaaccatagcagtgagcagacaaacgaattgtatgttcttgtatattttgaatgaggtgatgtcaaattaatacgaaaaaggtgatatggaaacatgagtattgaaattggaatttctctatctatttattttattggaatgctggccattggctggtatgcatttagaaaaacaaatgacttgaatgattatatgttgggcggacgcgggctgggtccttacgtgacagctctatctgctggtgcttcagatatgagcggctggatgctcatgggacttccaggcgcgatgtatacaacagggctttcgtcaggatggcttgctgttggtttgattagcggggcttacttgaattatctatttttagctcctcgcttacgatcgtatactgaggttgctgatgatgcgatcaccattccagacttttttgacaaacgatttagagattcttctactttattaaaagctgtctcggctgtcattattatgattttctttacactgtacacctcatcaggtatggtatctggcggtcgtttattcgaatctgcgtttggtgccaattatatgtttggtttaattttaacctctagtatcgtgatcttatacactttattcggcggctttttggcagttagcttaactgattttgttcaaggagccattatgtttttagcattagtgctcgtgccgatcgttgcctttactcaattaggtggcccaattgccacgtatcaagatatccaacaaattgatccaaaattgcttgatatattcagaggaacgagcgtcattggcattatttccttcttagcatgggggcttggttactttggacagccgcacattattgttcgattcatggccattacgactgtaaaagatttaaaaccagcacgtcgtatcggtatgagctggatgattgtgtctgttattggttcactgtctgttggattagtcggtgtcgcttatgtacatgagactagtaccactttagcagacccagaaaccatttttattgtgttttctaaggtgttattccatccgtatattactggatttttactctctgctattttagctgcgattatgagttcaatttcttcacagctgcttgtgactgcaagtgcaatgacagaggatttataccggactttctttagaagaaaagcgtcagacaaagaactagtaatgattggacgtatgtctgtattggtcgttgccattatcgcgctttgtctttcacttaatccaagtgataccattcttgaccttgttggttatgcttgggcaggttttggatcttcatttggtccagtcatccttctatgcctatattggaagcgaatgaaccatcacggtgcactagcaggaatggttgttggggcagttgtagtcttaacatggatttcaaccggcttgaataatacaactggcttgtacgaaatggttccaggatttattttaagtggtttgactgccatcattgtcagcctcttgaccaacaaaccatctaaagcttctaaaaagctgtttaccaaaatggaaaatcatcttgaagaagaaacaaaataaagaacatgaggggtcatctgccttaagcggatgactctcttttttaaataaaatgcttttctttctcccatttctgaataaaatagaagttgtgcagccatatgggctgtgagaagatcatatacatgatgtgaaacgtacatgaagtgaaggagcgatacgcatgttttggacgattgaatgggatacagtcttaaagttagccgtggccaccttaatcggtttgattattgggctcgaacgagagctgaagaaaaagccgctcggcttaaaaacatgtattgtcattgctgtcagctcctgcgtgttaaccatcatcagcattgatgcagcctacaatttccctcgagtctctaggcttcaaatggacccactcaggttaccggcgcaaattatatctggtgttggttttattggagcaggtgtgattctgcgaaaaagcaatgatgtcatctcaggtcttacgacttctgcgatgatctggggagcagcaggacttggggttgcaacaggtgcaggattttataaagaagccttcctcagtcttttctttattctggttagtgtcgaatttctaccgtggctcttccagcggatcggaccgattcgcttacaggaaaaagaaatacgcatcagaatgtctctttctgatcgaaaccgtatgacggatattttaaaagaaatgaaagccctcaatattcgcattcattctgttcgtattgatgatttaacagaaaagaactatccgattatggaagtacgtgtacgcgtgcataaagatcgctatacaactgatgtgtattttgatattaaagatctagaaggcgtcgttggcgtcaagtgtgatacggtataaaaggtgatgagtcaaaagtctcatcacctttttttatgggaaaaggggttgaaccatcaccttcattcaaataaaatacaaattatgaaataaatgataaaaggggatttttcatgggctctatgaatcgtaaaaaacgtatttatcttatgagtggaattctagtagtactcgtattcgctgctttattgacctcacattatgtcactcccgtatcaacaaatgcagcagacaagaaacaaacgaaaacaccaaaaaatattatttttatcgttggcgatggaatggggatgcccgtgatcaaagcctaccgcacattcaagcaggaaaagcttggttctccaaaagcacaaaccgtctgggacccgcatttagtcgggatgcagaccacacacccagatgatcctcgagataatattaccgactcagctgccgcagccacggccatggcgactggaaaaaagacatacaatgatgccatcgccgtcaaccaagataaagaacctcttagaagtgtcgttgaagcagcaaaggaagcacaaatgaaaacagcctttgttgtctcatctgacatcaccgatgcgacacctgccgcttttggcacacataacgtctcccgaaaaaacaaagaacaaattgcagaccacttttttgatgagaaaataggcggagagcacaaagttgatatccttctaggtggcggaatgcaatattttgaccgaaaagaccgtgatcttgtgaaagaatttaagaagagcggatattccattctaagatcaaaagatgatttaacttcccaatcatcttcgaaaatgctcggcttattccaagaggacgagctggatcgagccatcgatcgtccaaagcatgtgcctactttaaaagacatgacactggcagcattgacccaattaaatcaagacaattcgcatgggtttttcatgctgcttgaaggcagtaccattgattctgctggacatgaaaatgatgtggtcggcgccatgagtgagatggaggattttgagaaagcagtccaagcggctcttcaattcgctaaaaaggatcaagaaaccctcgtcgtcatcacagcagatcatgcgactggcggcttttcgtttggtgcagatggcatgacaagtgaaaccggctataaatgggacccagcacccattctagctgctaagaaaacacctgtgtatatgacaaagaaaatcgcagacggccaatcggtacgtgatgtccttcacaccaatattgatttctcactcacaaaaaaggaaatctcacaggtggaaaaagcggcacaatcagggaaggccagtacgattcaactcagcattcaacacatctttgatcaacgttctttctcaggctggacaacctttgctcatacaggtgaggatgtccctgtctatgcatatggacctgggaaagcagcatttcaaggctggatcgataatacaaagcaaggaaagaatctgtttcacatcattgaatcaccgtccacctatcgcccataaaaaaacaatccccgccttatcacagaggcggggattttgatgttaagattgacttagctttgtaaagtcaaacgttgtaatcggcgctgcttgctcaatgtcagagcggaagctagcgagcatggccttctcttcttctccgatggtagccaaatcaaatgcttgatgcagcaagccatagatcagcacgtgacgtaagcgaaggaagtcaggaatgtaggcaagccactcatccccaagctcattctcttcacgatagcctttaaggaactgcttcataaagtttcctgcaaaagctgctttgtcttcgtatggaatgactgggtaccacaacacattgtatagcaaaatgctaatatcattcataaaccaattgtacccgatatcatcgaaatcaaaggtcgtaattttgccttgatcccagtggaagtttccgtgatgaagatccgcatgaaccaatccgtacgtatcctgatttttcggaagctttgacagcttttccatcaaccgatccgcttgttcgaacacaagcgtctgatcggctggtacatacttacgtaatttaagctgctcctcttcatcccactcttgtcttttatatcgcgggtttgacagctgatagctttttgtcagtttatgcatgcggcctgtgtactgtccaagcgcataaaataattcatcattccagtctgcctcttcgactttatggcctggtgctttttcatagactcgcagcaaaaatgaaccgccttgcccatcgtctacttgctcgatatcacggccatttaatgaagcaattggttttgcaaccgaaagtccgcccttcgctaagtgatggagccattccatttcacctaaaatataatcaggtgatctgcggatggtatgggtaatttttaaaatgaaagactctccgtcttttttaagttcatacacatagttttctgcatctgcgataaagtggatatcacttcgctggactccgtataaatgagtggcctcatctaaaatttttgattcttcatatatggcttttacatctttatgcatgctgattctccctcttcatatattttgctaattctcgaatggtgtgtttttcagcaaaattcaaatcatcaacataccaacccttcttttcaatctctacttccattttgacagcaagtaaagaatttcctcccaaatcgaaaaagtcgttgtcaattcctactttttccacatgaagaatgtcacaccaaatttcaagaagcaatgcctcgcgttcattagttggctgtgcgtaaagtccttgatcctgcgttagttctgtctttaataatgatcgaagaccttcttgatcatgtaccttaagggcttttacataaccgctgtgcagcgtttgatctgtttgaaccgtttcccatgtgtaaccttcagaagctgaatgacttactgtctccaccctttgaccctctatttcttcagctgggtgctgacgaggtgacaggtggtcaacaatctgaatgtgatcacttagtgaaccgatttcttccacttgtatacggtatgtttgctgctcctcaatctcctgcatcttgttttctttcataaatgacttgaacagctcattacgtccagtcgatgcaaatgtgaattcaatagcagaaatctggtgctgacggctatactcagcgagccatgtcagacatttttgctcaatccctttccctagcgcacggcagcttagcatccatgcatcgatgatcaaggtgtcgcctgcatgatgagccaagatcgcccctacaattccttcatgactaaagcgatccgctgactcaataatccagccctgaacacgctcattttccaatcgctctctcagctgctgttcatcaaagcgctgatcatttaagcggaattggttaatgcggctgctcatttgcgccacgcgggcaaggtgcttttcttcccactctgttacactcatgttcaaattcaaatcttgtaaaaattgctccatagacggcgattctgcttgctctttttgacgagctttttcagccttgtagctcgttgttcgccctctatcttcatctgtaatatcatagcggtcgaatgcccaagcatgctgggcgaataatggaatcgctttttcattggcaggtaacagcagggtcatcacttcaggcagctcttcattcatacgcaagcactgagcaggatcatcgtctaagaaaataaactgagataatgaaagattcagtgaatctgccatctctttgagatgtgccggtttactttcccaattgatccgccagtcgacaatatcgtctttttgcaagatcatatctgggtggttttcaaacacgcgccacacatcttcttcattattcctgctgcttaagacaagcaagagaccttctttttgcttttgttttaaaaagcgctgaagcatttgatgttctggcgtaatatcgatgccttctataccgtcttctgaaacgacacctctccaaagcgtgtgatcacaatcaatggctgctaccttaaatggtgcaccttgccatgcaatgaactcacgtgcgacttttgttccgatggctccacaaaagacttctgtgaatgggagatgtgcggcttgctctccttttgcatcaaagatgtcattcatctgatattgctgcgcaagctgacggcaatcaatcaattgaacaccgtctatctcagataattgagtaatccactcttgttccacatcttgcagcgtgtctttaagagcagcacttatcggcagaatcccaacaaaatataggttatgtttcgtttttgatttcagaacgcttgcaagttcttcagcatgctctgcagcctgttttttcttttcttccagtgaaagatgagctgggcctgtaatatcctctaaacgaatgagcagaaggttcgcaccgtttttcttctgtgagataaggctgcgctcatttaataattcctgatatacctgcccatacggtgcaaattgaacatccagctgcacgtcaaactgtttggtccagtactgaatgtaaggtgcgatcggatctgctgtaaatgtcgagctgaccgttagtacgagcggtgctttttcctctgcacgctcccttttctcctttgctgcctgttcttcttcctgtgaaagaacagcgaaatccttgagcaattgatcaggtgtttgaacagcctgttcgaccaagtgctcgaagtgcttgacgaacgcttgcattgtctcatgtttaaacagtgcaagattgtattgaaggacgcactttaactcacctgttacttctctaacaacatccattttcatatcgagtttggaaattccctttgcaaactcatgtgtttcaaatgttagtccatcggcttcgattttaatattcggatcgtactcattatggtaaatgagcattgtatcaaaaaatggattgcgatgcggtcttgtttttggattcagatgctcgaccatttgatcaaatgggtactcttgatggtcatacgcatccagcagcacttgctttgtctgcgccagttgctctgtaaaggttgcgtcttgtaccatgtctagtttaataggcaggaagtttgtgaacatgccaattgtatgctcaatatctgcatgacgccgtccagccacaagtgacccgacaatcagctcctcttgatctgcataacgtgagagcagcagtccatagagctggaacaagatgacgttatttgtcagctgatactgttcagcaagctgttcaattttctccacgatgtgcggttcaatgttgaatttgatcgctcttcctaagaaggattgttccttccgttcaaaatcatatggcattgtcaaagttggcacatttgagccaatttgctgcttccaataatcctgctgcttttggaacatctcgctgcggaaatatttgtcttgccattctgcataatctttatattgaacagtgagttccggcaaggtttcccctcgatagagctcagtaaattctttaataaagatgttcatgctcgctccatccgccacaatattatgcatatcgactaataagaggtgatcatgtgctgctattttcacaaaacgcacacggatcaatggtgcagcctttaagtcaaatggacgaatgaattcatcgatttgtgcttctaatccttcttcatcagcctctgtcaattcaacagcaaactggaagtcatcatggacccgctgaaccggttcaccatcttttaattcaaaggtcgttcgcaaggtttcatgacgatcaattaattgcttgaaggtctgctcaaagcgctcgacgtcaatttcccctttacatcttagtgccatcggcatgttgtatgaggtcacttgaccaatacgctgatgaatgaggaatgtccgtctttgagcagcagataatggatacgtgtctttcttttcgactggttcaatcttgaaatattgatgcttctcagccttctcgatgaatgcttggagcttttcaatcgtcggattgttaaacatatctgtgagcgttagctctacaccaaactctttgtgaatttgagaaatgagaccggtggcatttaacgaatgtcccccaagctcaaagaaatggtcgtctctttccaccttttcaattcctaaaatgtctttccacatccgctgtaacgttgcctcaatgtcattcgatgcggcggcatggacttgattgttttcttctatttcctgtgtcttgttttcctttggcaccaccatttgcacacctaaagatgaagataatgcagctgtatctaccttttcaatccaatatcgttgtcgttcaaacggataggttggcaaggatactttttgatttgatgtctgatttcgcaatcttgtccagtcaaccggcaccccttgaagccagatgtcacccaatcttcccagcaggtagcggtcgtcggctacctcttcttttggatgacgcattaatggaatcggctgctgatgatgttcctttgaagcttggcgaataaaggcacttaacgtattccctggcccgacttcaacgaaaataggatcaagctccgttaataatgtctccgctccatcacggaaacgaactgcttgtcgcaaatgatcagcccaatatgccgggtcttgcactgcttcatggtcaatccacgaacctgtgacgttagaaatatacgggatagacggcgcattcaattgatactcggcgaccttttctttaaatgatggcaagatgtcatccatcattttagaatggaaagcatgagaggtgtgaagctttctacacccatgttcagcagcctccagcttctcagcaagtgcatcaatggctgcggtctcacctgacactacgcacaattcaggaccatttactgctgcaagtgaaagttcatctgttaaatatgacagcacgttctgttcactcaaaggaacgctcagcatagagccttttggaagctggctaatgagctgtccgcgataagccacaagatctacggcatcttcaacagatagtaaaccagataccgcagcagccgtgtattctccaatactgtggccgatcagtgcctgcggtttgacgccaaaatgaatcagcaatttagccaaagcatattccacactaaacagaagcggctgcgtgtattctgtttggttgatcagctgacgatcatcactttcttctgttgaaaacaaaagacgaaatgggtcaactgagacatgctgtttgaattgattcaagcattgatccagcgcttccttaaagactggatatttgtcataaagctgacgccccatgtctacatactgagatccttggcctgggaaaagaaagacgactggacggctcgatgtttgggagctggccgtcttgaccacctcttttgacctttgactgagcgcctgtagcatgtcagccgtgttacttccaagaatgacacgtttatgcgggaaatgatggcgccctgtttgcagcgtataggcaacgtcacttagacggacttgctgctgatgctggagtaagtagtccgcaagacgatccgtcattttttcaagagctgctggtgttttggcagataataaaagaagttcactctcctcagggctatctgttgctacacgtgcagcaggtgcttcttctaaaatgacatgagcatttgttccacctatcccaaatgagcttacacctgcccggcgaggagattcttgcgtgctccatggcgtcaaatctgtgtttacaacaaaaggcgaatcggcaaactcaattttttcatttggtgtttcaaaatgaatggtcggcggaatcacttgatgctttaagcttaaaacggttttaataaagcccgcgacacctgatgcatcattcaaatgaccaacattcgatttgacagaaccaatccggcaaaagccttttttatctgtatcaaatgcttgcttgagcgcttcaatttcgatcggatctccgagggttgtcccggttccatgtgcttcaatgtacgaaatggtttcaggttccacctcagccattcgaagtgctgtcttaatcgctgaaacttgacctttcgtacttggtgctgtatatcctacttttctatttccgtcattattaatagatgatcctttaatgacagcataaatgtgatcgccgtcttcaatggcatcctctaaattttttaaaataacagcacctgcaccatcaccaaaaacggttccatcggctttgttatcaaaaacgcggcaatgtccgtcagatgaatggatcatgccttcttgatacagatagcccgatttttgcggcaggcgaatggacacgccgcctgcaactgccatatgacagtcgccgcttaataaagcctgaacggctaaatgaatcgacaccatcgaggtcgagcaggcggtttgcaccaccatactcggtcccttcagatttaatttatatgaaatcatcgtcgctaaataatcacgcatattcagaacggcagcttccagtgttttcgaatcttcaccttgtgccgccccttgaagtgctctcatgacccattctgtattgatccctgcacctgtataaagaccgatttgccctttatattcaaacggatcgtacccagcgtcttcaagcgccgtccaaacacattcatgaaacagtctaaactgcgggtccatcatagccgcttcctttggtgtatagtcaaagaaatctgcatcaaataaatccacatcatctagcattccttttgctttaacaaaacgggggttttttaataaagcttcatctgtaccttcacgccgtaattcttcctctgtaaaaaaagaaattgtttcttttccctttttcagattctcccagtactcatctacatttttggcccctggaaaacgacctgcaagaccgataacagcaatttctgcgccatgataatgattcgttgtatcattcattctcgattccgcctctcaatcttttattccgttgctgtttaaaacgagctcttcgatcacctgaagtgacgacggctagttcttcttccatcgcttcttccttcgagtcctcagaaggctggatatatttcgcaagttctgcaacagaagggtacgtaaacaaggtcacaaccgcttcatttgtttgaagtgcttgatttaaccgattggtgacttgaacaatatccagcgagcttgcgccgagatcaaagaaattgtcgtgaatgcccacttgttccatgcccataaaatcctgccatacttgacagatcgctttttcagtttcatttcgaggcgccacatatggattgcccagctctggtctttcgtgcttagacacttcatatgaatcctcatctggtgcggtcttagactctagtgacagccattgatctatccgttcatcaagatttcctgtggacacgagcatgtgtcgattctgccggttagacagaacatactggaacagctcagcaccctcttctggtaaaatcgcaagctcattgatcgattcaccaattgtggattctagctcaccccagaaattccatgcatcccagttcacacacatccacggggtttgactatgttgattaagtctagctgcaaatgcatccatatataagttagccgctgagtaagcagagaatcctaagcccccaagcaatgcactaatggaagaaaagagaagacaaaagtctgcttgttcttgttccagcagctgctctagcacatccagccctttcacctttgattggaattgatcctctccctgcgccagtgtagaagggatatctttgatggcacggaaggatgtacttcctggtaatcctgctgcatggaatacaccatgaacgccgccatgctttttgcgaatggcatcaaatacacgtttcatctgatcaagatctcctgcattcgcctgcaccgcttctactgttgcccctaatcgttcgagctcaagcaccttttcaattctcgtgcgctgcgcttcatcggcatttgcttgttgaacatatgacgcccattcatttcttggcggcaatgccgttcttccagttaaataaagatgtacatttccttccttcgccagcatctttgacagaacaaatccgataccacctaaaccccctgtaatcagatacacaccatttggcctgatcatcttcggaagtccatcttctttttgtagcggcaaatgcttgtagctctctacccagcgctttcgatgacgatacgccacaagctggtcctttccaggctgcatgatttcctgcaaaataagatcgacaaggacttgttccttccaagacatgacttctggcacgtcttccacatcgatattccagcacttaatatgatggtattcctgtgaaatgactttacatggtccaagcattgcacttttctctgcacatatcgtctcattgcctgtgactggctgaattccgctagtgatcgtaaacagacggcattctcgaatatttttttgggcagcaatcgcttgagataagaaaattaaactgtaatagcctttttcaatgtgcgcctgaaaagcagcttgacgattcgagttgtcatcttctttcgcagcttcccataaatgcagaatccgctggatattgatgcctctattagacaatgaatctagcatatttcggtagtgctggccttctgccggattgatcgtaaacgaatcatcttgcacttgataagcttcaccctttgtgactgaaatgaccttgatccctttttgcttaaatgaatgggtaaacagttcatgaaaagcatcctgttccctgaaaatgagccacgtttgttcttctgtttctttttcgaaaactggttttagcggctgctgttcccatgaaggcaggtagaaccattcttccatctctttcttcttcgtttccttaggggcggatagctgcggagacgctgactttcctgcttcaatccaatatcgtttccgctcaaatggataggtcggcagcgatacgagctgacgttcctcttgagttggatgttgctgcgctttgacctcgtagccccctgcccatagctctcctattctctttaagaaatatgcatggtcatccgcttgttctctcgtatgcctcaccatattcaggacatcatgatgtgactctttgttttcatgacgtttcgctaatgccgtcaagctgtttccaggtccaacttcaatgagtgctcgtacttcatcggttaacagctgagatagaccttcatgaaaacgaacggttccacgcaggtggttcgtccaataagatgctgtcatcacatcttcacttgtcgcccatgtgcctgtgacattcgatataaacggaataaccggctcttgcaattctactttttctacgatttgttgaaacgcctcaagcatcggctccatcatgtaggaatgaaaggcatgagaagtatggagctgtcttgtgataattcctttgtcttgcagtttcttttcaaatgcagcgatatgctcttctcttccagaaacgacacaaaggtcttttgcattgacagcagcaacagaaagcgattcatcgatcatcgagacgagttccgcctctggtaattgcacactaagcatcgcgcctttttccatgtcttgcattaatcttcctcttgccatcacgagtgttaatgcagactcgagagaaaagacccctgacaaacaagcggcaacgtattcgccgatactgtgtccaatcattgattctggctcaacaccgctatgttgaagcaatttggctaatgcatactcaaatataaagaggagcggctgggcatttgacgtttttgtgatgtcttcgttcgtttcatcctcggaaaaaacaatgccctttaaatccacttgctccgtttccattacatatttaaagcatctatctacttcccatttgaacactggctctgcatcatataacccgcgcatcataccagcatactgagcgccttgacctgaaaacataaaggttgctttgcgccatttttggcttcggaacacactcgtttcaagctgtttctgctgcatccattcatcagcagacgcgagtacgatcgcttttcggtatggaaactgctttctgccataccgcaatgtataagcaatatcttcaagcggaacttgaggatgctggatcacatactgctttaattgctctgtcattttcgctaaagcagtatctgttttagcagataagacgagtagctgcttttgggtagaagctggtttttgcttcgcctgtatgccctcttctatgatcatatgagcgttcgttccgccgataccaaaagagctgactcccgctcttctcggaccatctgcttccttccaatacaacgccttttgattcacataaaacggtgtatctttgaaaggaatttcctgattgggtgattcataatgaatggttggcgggatcgttttatgctggagagccaaaatggctttaaacagacctgcaatccctgccgcactatttaagtgtccgacattacttttcacagaaccgatcggaatcgtcagcggatctgtccctttgaacacttggctaagagcggatacctcaattggatctcccatttttgtccccgtaccgtgagcttctatataaccgatagacgcgggatcgatacctgatttttcatacgtttcttttaaaacctctgcttgtccttccacactcggagcggtaaaaccagcttttcggctgccatcattgttcacaccaacccctttgatgaccgcatgaatcgggttgccgtctctcatcgcatcttcataacgttttagtagaacaattcctgctccatctccgaaaatggttccgctcgcctcttggtcaaacggacggcaatgtccatcttttgattgaatcatcccatcttgatagatgtagccgatattttctggagaactgaccgtcacaccgccagccagtgcggcatcacattcttgattcaataatgcttgacaggccatgcctatgttgacaagtgaggtcgaacaagctgtctgcatggtcacactaggcccgtgcaaattcaatttataagaaagctgcgtactaaaaaactcacgatcatttaacagcatggcgctgaactgctcagttgcttccatttgatgggcaaagcgcgtcagccactcatggtttggactcgttcctgtataaacgccaattttccctgctattcgatcagggtcacagccagcatcctccagcgcttcccaagcacattcatgcaagagcctgaactgcggatccattagctctgcctctctagcagaatagttaaagaagtctgcatcaaagccttcgatctcttgtaaacgaccttttgctccaatgaaattcggatgctggtagacagacgcatccagccctgctttcttgagctcttcttctgtgaaaaagtgaatcatttcctcgccattcacaagacgctgccaaaagtcttctagcgatgaagctcctgggaatcttccagccattccgacaatcgcaatatccgtatgctcttgggacgtgttttttactgggcgagaagcaggcgtttgaacctgttctgactgttcttcaaataaatattcagcaagacttgccactgtcgcaaaccgatacaattgcacagtgtcaatttgcttgtcgacgtgctcagatattttcgctgcaagctgagaaatatcaagggatgtcgcaccaaattcaaaaaatggcgattcatcatccatttgatcaaacccaaaatgagtttgcacaatgtcgtgaatctctttttgtaaagaagcgagtgaagcaaagacacgctgttcattctgcggcttttgcggttcaatggctgccatcgtatttgtttgtgcagagaaatcggttttatgaaatgggtacccaggcagcggaatacgctgcctgttcttctcatctgttaaaggaaaggctaagccgactcctatttcccaaagaacacctgcgatttgaagcatgtctccatcaagtggttcggttgttttttctactcccttttcaaatacaatcccttgtttcattgaaaggtcaatgatcaaagctggtgattcttgctcaatcattggtgattttacaggctgatccatattaagaagaccttttgcagacgatgggtcgaaagtgattagttcctccccggtttgctgcaagtaaacaggctgctttagtgtcctctgaggcagggaagccagcctttgattaaccgtctcggtgtcatgaagatggtacacaatagataccgcatcgtttagctcaaggccgcctgctgcatataaagctgtccagactccgctgccttctccaatccagccatctggttcaattccgattgatcttagcatgttggcaaaagccgatgtcatgatcagcatcgccacttctgattgacggctttgtttaggatggaacagctcatcttttttgataggtacagcgggttggacaaggcttacgattcgatccacttctgttttgaaagaaggatctttctcatacagctcgatgtaatcacgtaaacctgactcatggtaccccttcagcttcatgttgatccgtttataaagatgactttctctgcctgctgtctcttcattcagcaattgcagctccgctaataactcttcccgcgtggaacagacaaacgcttttcgatatttgaaagcctttcttccactttgtaatgtataagctgcttcaccaagtgagagatcaggatgtgaggagacatattcctttaagttttttgtcatgttcttcagatcatgcgttgatctagctgagagcacaattaattctttggacgaggccttgctgtttgtttttctcggctgtgcctcttctaagatgacatgagcatttgctccccctataccaaaggcactgactccagctctccttggcaattgagatgtcttccactcctctttgtctgtcccaacataaaatggggtttgatcaaaagaaatacggtgattcggcttctcaaagtgcggcatcggggcaaattgacgatgatgcagcatcatgactgttttgataaaaccagctacgccgcttgcggcatctaaatgcccaatattggctttgactgatccaattcggcaatagccttgttgatctgtttgaaaagcacgagtaagcgcctcaatctcaatcggatctccaacaggcgtacccgttccatgtgcttcgatataagaaatcgtctctggttctgtctcagccatttctaacgcagattcaataacacttgcctgtccactcacacttggggctgtatagccgactttattacttccatcattgttcgttgcagatccttttacgacagcataaataaaatctccatcttctatcgcatcttttaatcgttttagtgcaacaacgcctgcaccttcaccaaaaacggttccttttgctttttcatcaaacggacggcaatgaccatcaggagaataaatcattccttcttggtattgatagcctgtgatttgcggctgatggagtgtgacacctcctgctaaagcaaggtcacattcaccgccgattaatccttggcaggccatatggatcgcaacaagcgatgtggagcaagccgtttgcaccgatacgcttggaccttttagatttaatttataggcaattcgagaagcaaaggatgggtcattgagatgcatgatttgaaacacatcttcgttctttgcaagtgacgacatatgctgccccatccacgatagattgctagatgccccagcataaagaccaattaaaccttcgtattgctcaggttcatagcctgcatcctcaagcgcatgccatgtgcattcatgcatcaatcgaatttgcgggtccataatcgatgcctctcgcggagagtagccaaaaaagtctgcatcaaatgatgatgcctgttttaaatatggctttgccttgacataatcagaacgttttagcagcgtctcatctacacccgctgcctttaattcttcatcagtgaaaaacgtaacggattctttcccttgcgacacattttcccaaaacgcttgcacattcggtgccccaggaaatgtacctgctaatcctacaactgcaatttcaagtccagattcgctccattgctcttgatcagacatacgctgcatttctcccatctattttcgttttaatctctgtttacggcggtttttcccatctgccatcgcctgtttgcggagattagatgattcagtgacagcttgcttttcttccttcacgccatgtatcttcttcagttctgcagccaatgacgcgatcgttggatgactatacatcatgaccactggaacctctatcccataaattgatttaatatgaccgctcatctgcagcaaatcaagggatgtcgcacccatttcaaagaagttctcattcacatccggttcatgaggaaaaaaggagctgagtgcatcactcaatgagacttctaggcgatcatctatgacctgcgatatttgttgcgacgactctttttcctcctgcataggtgttaagcggtgctttattctctcacccatgtctcgaacagaaacaagaatttgtggatagtctagacgaagcacttcctgaaaggccttgattccttcttctggtgaaattcccgcctgctcctcgagcgccatcatgtcattgactttggccgctaatgctgagtcgtgtgccatgccgactttttcccatcgatcccagtttaatgaaatcactggctttctttcctgtctcttcgcatgagcaaagctgtccataaaagcattggaagccgcataagccacttgtccagccgctccaagaaaagacactagggatgaacaaagtaaaacgaagtcgagcgtttcattcttgagtgcttcatccagcacataggtcccgttgatttttgcctgacacatgcgaatttcatcgtctgctgttcttgcttggatgatcttcccatctgcctctcctgccgcatggatgacaccatgtaaatcgccaaacgttgtatgagccagctggaccgctttctgcacagcgtctttatccgacacatcaccgtgtacagttagtacatcagctcctaactcttcaagagtcatcagctttttcacggtttcagcttctttcccatctgcatcactcagctcatgccatgcagagcgttcacgtatctgtgatcggctgaggaacacaagttttgcttgatacgtttctgctaaatgttgagctagtgtgaagccaatgcctcccataccgccggtcaggaggtaaacaccatgagtcctgaaaggctgcgtggacgattcctctttacttaaaggtgtacttgaagcttttcgaacccacctgctgttcccccgatacgccacaagcgcctcttgatcgtgcattgccacctcatatgaaagaaatagcggccagtccgcctttgtttcctgacataaatcaacgtgctgacacgcaatatgctgatattcttgaggaatggtcagagctagtccagtgcatgttgcttgaagaggattgaccttctccatcccgatgacatcatgcgcttgatttgtcacaagatgaagacggatggttgtgttatgatgctgactgatgagcctgacgagatcgagtacagataagtagtttggctgatcacctgtatcttctgtcagttcatcatgcatccagatgatctcttccggtataaacccagattggtgcagttcagccataacccactctaagtgtgacagcatatgaacgtcagccttcatcaactggtcattttctttgatcgtatgatcactttgacagacgctgacaacttctgcatgccgttctttcaaatagtcgccaatatgaccacttttctcaaaaaccaagatacgcttcccttgatgatgctgctcttttagtacaggtgcagagcgctcccacaccggtatataaaaccagtcttcaaaatcagcggagaatttctcacccttttctgatggcgctatagcggtcatcagctgatctgctttaaactgcggagaggggaatatttgatgctcgaatggatatgttggcagtgacactcgatatggggccttttcttttctgacagcgctccagttcggttccactccaaaactccacagcttccctatagcttttttcatatattcatcatcagcagcttgttcttttgggtgtctcaccaatgaaacagctgctgctttgttcacatcatagtcctcatgtcgtttcacaaattgagtcaacgtatgacctggccccacttcaatgaaaaccacttctccaagtccaagtaacgtctctattccttgactaaataaaacaggctgcctgatatgagatgcccagtaatcaggcgatgatgcttgctcatttgttaaccagttccctgtcacattcgaaagaatcggaatctcgccctgttgataggtgatttccaagagaacgtgcttaaactgtttggacgcttcagccatcatactcgtatgaaaggcgtgagaggttttcaatgtttggacagaagctcctcttttttcagcttgttcgagatagatctgtaatcgttctgaaggaccggaaacaacagataattgcgagctattcaccgcagaaagctcgacaccttcaggaagatcatgttcaatctcttcggcagagagtgacactccggccatttcaccccgaggcattttttgcatcaaactgcctctttttaaaacgatacggattgcatcttcaaggtgaataataccggccacgcaggcagctgttatttctccaatgctatgaccaatgaaataatgcggacgtatgcctagtcccatcagcttcgatgcgagcgcatactcaaaactaaacaagatgatttgtgtatatgatgtttgctgcatgagctgttctgcttttatgaactcttcttcggttgttgggtataacacgttctcgatctcaacacctgataaagataaaatgatggcaaaacatttctgaagcatttgtttaaattcaggatctttctcatataaatctttgcccatattcacatactgagcaccttgtccagaaaacatccagacgactgcaggctgttgaaaggccttttgcggctgtcccgctgactggaatgtgcggtcaggacctgcaagaaaagcttgtcgataaggaaaatgctttctgccctcttgcagtgtaaaggcagcctcggatagtgtgacacgcttttgatcttttaaataagatgtcatttgttcagcagatttttgaaccgcctgcttcgatcttgcagaaatcaccattagttcatgatctctttctactgacggtttgtcggcagcgggtgcctcttccatgatcagatgtacattcgttccaccgactccaaatgaactaactccggcacgcagcggctgctctgttttcgtccatggtacgggtgttgtattgacataaaatggacttgattcaaaatcaattttcggattcggctttttataatgaaggctaggcggcagcatctgatggtacagactaagcgttgtcttgataaaacctgcaacccctgcggctgaatcaagatgaccaatattggttttcacagacccaatcgcacaaaactgttttttatccgtttgaaaggctttctttagtgactcaatttcaaccggatctccaagagttgtacctgtgccatgtgcttcaatataagaaatactctcagcttctacacgactgatgttgagtgcctttttaatcacttcgctttgtccttctatacttggtgctgtgtagccaactttccgcccgccgtcattgttataggctgaacctttaatcacgccatagatatggtccttatcttttagtgcctgctttaatgatttgagcacaacaacgccgcagccctcaccgcctacggtaccttctgcctgttcatcaaaagcccggcagtgcccatctggcgacatgatcatcccctcttgatacatgtatccttttttgtgaggggtcgtaatggtgacgccgcctgcgagagccattttacattctccggtaattaaggcgcgcgccgccatatgaatggcagtcaaagaggaagaacaagctgtatcaacagctacgctcggccccttcaaattcaatttataagatacctttgtgttcatgaaatctttatctgttaactgaacagccgcaaattgttcggaagagtgattcgttctcatcagcatggaagcagcttgccaatataaattagcagaggcggctccaaataaaccaatcggttcctgataggtttcaggattatagcctgcatcttcaagagattcccacgccacctcatgaaacatgcggatctgcgggtccattacttctgcttcacgctgtgaataaccaaagaaatctgcatcaaaatgatcatgctgatcaactgctcctttggcacgtacatattgctcatgatccaatgcttctttctcaacccctgcctcaagcagctcttccttcgaaaagaacgtaatagactctcttccatttgcaaggttgtcccaaaagtgatgaatattctttgctcccggaaaacggcaggccatcccaaccactgcaacctctaatcctgtgaacttactcatctatcatcccgcctaacagttgagcggcactttctaagtcatccgcttcattttctccatcatcttcgatttgtttctcttgccctgatgctttgttttttatttgagcagctatttgtgaaacagttgtaaattggaacagctccatcactgtcagctcctgctgaaattcctctttcactttattggacaactcaacgatattaaaagagttcccgcctaagtcaaaaaacggttcatctatacgaatctgcgaagcagggacttgtaaaatagaggcgaaaatgcgaacaagcttctgctctgtttcattatgtgcttgaatggtcacaggctcttgattgtctgccagctgatcttctggattcggcagtgcttggatatccaatttccctgatagattcaaaggaaattgctctatttggatgacatgtctcggcaccatataacctggtaatctatcacttaaagactgacgaagcgcgcgctgatctatcacttgttttgccatcatgtatgcgcaaatgtattggtcctgatcctgcgtttccttaggaatgacaatgacatcttgaatcaatccttgcatatgcgggtcatcaagaatcgctctgcggatttcctctagctcaattcgatatcccctaattttcacttgaccgtcgtttctctttgcaaattctaataaaccatcaaaccgccatcttgcaaggtctcccgtacggtataacatcccgctgctgagctctggttttttaataaatttctccttgctcagatcagggtgattgatgtacccacgacctacaccatcgcctgttatatataactctccaaaaacgccaatcggaactggctctccttgcgcatcacatatgaaaatatgctcattcggcatcggctgcccaataggaatgacttgctcatcccagtcttggggaatcaaaaaggatgatgactgaaccgtacattcagtcggcccatacgcattaatcatgatcggtttttcacctgatatatgctgtaaaaattgatccatcagctcttttgtgaacacctctccgccaaccagcagcatgttcaacgcaggcaggtcttgtcttgattgcgctgctgctttgttcatcagcttcaagtgggagggggtcacatcagacagctgaatgtgatgttcttggtaaaacgaccataacgcatgcccatccatacggacttcatctttggcaatatgcagcgtatgtccgaggagcaatgctgggaacaatgtttgaacagacgcatcaaaaatgtgtgaagctagcatccctacttgcaaaggatcagggagcagatcaaaaaagcgcgttttcattccatataccaaattaatgacatgacgatgttcgataacgacacctttcggatgccctgttgtacctgatgtatacaggacatacgccatatcggaaggcgagatagaccaagtcagattctcttttattgatgattcttgaagcatgtcttgaatcacatgaacctcgacatccaatccttcgtgtccttctgcatccgagacaatagctgcagcgccgctgtttttgagcatataccgaattctttcgatcggcagatggacatcaatcggtaaataagcatagcccgcctttaagatgccaagaatggcaatgactagttcagcagatcgatacattttgagtccaacaggagtctcacgtgttatctgactttgagacagtctaagcgcaatgcgatcagataaatgatcaacctcttcatatgtataggaggtagtgccaaacacaacagccgttcgtgctggatgcaatagaacttgttgttgaaataacgacacaatatcacggtccactggataagtgagcgactccccttgaaacgaatcaaacagctgacttttctctacatcagataaaaatgagtgtgtgctcatcatttgctcaggcgtttcgagacattgctctgtgaatcccatgaaatgattggagaactgctccatcatgtggtcatcataaatggaagcatcccagtgaacttcagcatgaaggtgatcttgttctttcttccaaacaataagcacatccgcatgcagctgctctcggtcagcatgcccatgcaatggttcaaatgcacatgccagattgacacgcttcttgtcttctcctactgaacgccaaagctcatccattaatatttgaacaggatagttttgatgacgcactgcctcctgaaacgattgtttcactgcctctagccctgcgctaaagctcatatgaggctcaatctctgccttaagcggcagcatatgattgatggcggattgattggcagactgttccattgtaggaacagtcaccatcaattcagtttttccgctataacgttgaagcaagccaaaagctgctgtggttagcacgataaacagccgcaaatcagaatctccgcataattgctttaacgaatgattcatagccacagggaaggacgaatgaagcgatcggttcattgcagcaggctcggcctttgaaaccgtatgaggaatgcggccatcaagctggacacctgataagatcgatgtccagtaggctctttccctcaccctttccttcgccgctgctttcagttgaaaatcatcatgttcaatcactcttccattcacctctttacttatattttcaagtcatctaattcgaaaagagatacgtcatctaattgctgaaacgaagaagtcagttcgatctcctctattcttacagcatctactgaaacagcccgcatgatgtctttcagcaagcccgcaatccgctctatggtttcctctgtgaaaagctcagtattatattcgatcgttgaagaaagaccgtcttcctgctcatacgcaatccagagtaaatcaaagcgtgacgttcctgtctcatacggataatcactaaaggttaaaccacctaccttcagttctggctgattcatgttttgcaaggcgaacacagcatcaaacaatagatttcggctgacactccggcttaactggaggtcttgaaccatttgttcatattgataatcttgatgtccgaaatcatcgatgacgtgtgctttcacatcctctaggaattgctggtacgtcagctctgctttaggatacaaacgaagtggcagcatattgacaaaaataccgatcacttgctgcagctcctcttgttttctccctgctaccggaaccccgaccgtgatatctgattgtccgcttaatttgtgaagcaaaatctgatatacacttaacaagcccataaacagtgtggcgtcttcctttaaaatcacctgtttaaatgcgtttagctccgcttcttctatacggaacgtataatgcccgccgcggaattgtctcacctctggtcgatcgaaatctgttggcagatcaaggaggggggcaccctctaaccgatctttccagtaatcactcgattctttcagtgcttctgatgctagcaggtcattttgccattctgaaaaatctttatattgcagagcgagaggctcaagcgtcctgccgtcatataactgcataaagtcattgaccaaaatatcttgagaaagaccgtctgaaataatgtggtgcatgtccagcatgagcacgaattcctcttctgccagcttcatcacaccgactctcatcaatggagcctcacttaacgtaaaggcagtcaaaaattgttcaatcacttttttttgctcttcctcagatccttgtgtcgatcccttagtgaggtcaaataatgtgactgcaaatggtacctcttcttcaatcttttgataagggacaccattctctaatacaaacgcagtccgcaaactttcgtgtctcttaataagctgctgaaatgcccattccaacctgctaatatcgagtttccctttgattcgtcccgctttaaactcgttgtatcctgtgctgtttacatccatttgctgcatgagatacaaccgtttttgcgcagacgacaaaggataatgctccttcacttcggctttttcaatcgcatgataagcagcagtatctgcttgatcgatatatgctgccattaatcgtatcgtaggtatttggaaaaattgtggcagcgtcagctctacactaaatgcacgatgaatgataccaatgaaggtaatcgcctttagagaatctccacccatttcaaagaaatgatcatctatgccaatttcatcaatcttaaagaaagcttgccaatgttgacttaatgctttctccagctccgtttctggtgccgcataattcgtggaaagcgctggacgagaatacaaattgccatcttgttcatgctcaccgccgctctcttcctcaagggataaacggtctacatatcggtgaatacgatcatgtaaagatgttgttgaaataaccatttgttccacttgatccagtgaaagcaatcgttcaaagatcattcttccttctttttctgtaattaacgtttcggtgacatcatctccgattggaagatcaagctgcttcccttgctcaaattcccagccgtcaaagctaatgacagaccactgtgtttctgaacgtagattgcgttcatacacgtacgcatcgatgaaatgattcacagctgtataagctgtaaagccgagtccgcccaagatcggtgacaaagatgacaggacaaaacagaaatcaagggatcgatcacctaaggcatcatcaagatgaagtacaccattcatcttcgcttcaaaatgcggctccgaaaaagtgacatctgtttgctccatcacctggaaggattggtcgcctgtcactccagctgcatagatcacgccattgatctgtccatatgacgcatccactgtgttgatcaattgctggatatcttccttgtgacgaacgtctactttctgaataagaacgtctgcgcctgcctcttccagtgccatgaccctttgtatttttttctttgttggatcctgatcatcatgcgtagacagccattcttgccacttgctcctatcagggagtccagatctgctcgttaagatcaatgttccctgtgtttgctcggccaaagtctgggcgatattcaatccaataaacccaagtccgccaattaaaatgtacacaccatcttttttagccaaatgagcatgtcccgtttcgggaactgaacctttcgcatactttttcacatatcgtttatttcgtcgatagaccgtgagaagcggtccagacgctcgatctagctcatcgcttatttgctttagcaatctcttttcttgaaccccattttccactggacgatcaatatcaagaatgcggtaacgtaagttcggtgtttcttgtgaaatcaccatggcaggccctagatggaccgctttttcaggataaagtacaggctcaccgccaacggcatacgtcaacgaggaaagtactgtaatcgataccttttggtccaacacatattttttcagtgcctggccgatgtaaagcaaggagtaataagcttcttgctgcgtttgcttcacccattcttcttccgtttgagatggctgtctttctgaaagcccccatagatggcaaacttttgacacgttgatttcgtcatctgccagatttgatatgagcctttcataatcagatggctcttgtgaccgaatggtatagcttttttcgtcatgcttcgtaaattcatttcctttacgaaccatgacggactcgttccgtttcgtcaggagctcagccgtaaccttctctccaaatgcagatggatctgcaaacaaaagcaaggctccgtcagacgtatcttctaatggcacgcaaggtaaaagatccgcttcccaatgaggggtatagaaccattcatccatttgctgctttcgtccagactgctttggtttgtcttgtttcacacgatctgctgcatcataccaataggaggtttgatcaaatgcatacgttggcagcggcattttccgcggctgacggtttaaatggaacctatcccaatcaatagataatccgtttgtccatagacgtccaatttgaccaagtaaaaattcagtatccgtcacatcttgttttgcatgccttaacacatgacatacatgctggttcaggccgttcagcgaccgattgaccatcacgcttaaatcttgtcctggtccaatctcaattaattgaatattgtcctcttgtaaaatatttgtgatcccttcagcaaaacgaactgtatcggtcatatgccttttccaataagacatatccttcgctctcgtatctgtcatccaatctcctgacaaattcgaaatgaatggaatgcgaagagactcggctttcatatgtgttaatttttctccgaattgctcagctgcctccttcatgacatgtgagtgggcggcaatggttccacctaatcgcatacacatcaatctgttgcttttcagctcttgttcaaattcactgatcgcctcttctagacctgacacaatacatgatgaatcattgacaaccgcgagagaaatatcttttggaagcatcggtttgagctctgcctcaggtaatggaacactcatcatgacgccagctggtgacgactgcatcgcattcgcacgataggcgaccatggacattgcgtcctttaagctgaatagccctgatatggcggctgccgttaattcgccaaagctatagccgatcattgcatcaggacgaacgccccattcaatgaaaagcatggataaggcatattcaatggcaaaaatggctggctgtgcatattgagtacttgccaattgttcacgcgccttttctgtttcagccgctaatgggtacagaatacgtgcaagacttcgccccgttgcttcttcatatgcttgaaaacaagcatccatttgcttcttaaagtaaggctcttcccggtacagatctaatcccatattgagatattgattgccttgtccagaaaacataaaaataatcttttgtttctccacatgcgaatgcatgagctttccaatgcccttgccttgcttttctgttaatacgcgtaaagcatcttctctgcttgccgcaacaaatgtctgacggaaaccaaaggattgtcttcctgtttgcagcgtataagctgcgtctgccaaattgatagaaggcgtgttgtctatttggcttgcgagtttggctttcattcgttccaagctcgttttgctctttgctgaaagaacaagcagctcagcagaacgaggcatttgctgacggtctctttgtggcgcttcttctaatatgacatgtgcattcgttccacccattccaaatgagctcaccccagcccgccgcaaatgggaagctggctgcttccagtcggtcagctcagtattgacaaagaaaggactatgatcaaatgcaatgttttcattggcttttttgaagtgaagactaggtacaaatgtgtgatgctgaagcgaaagcacagctttgatcaagccagctgctcctgccgctgcatccaaatgtccaatattggttttcacagacccaatgcggcaaaattgttttttctctgtgtcgaaagcctttgtgagcgcctctatttcaatcggatcaccaagtgatgtgccagttccatgtgtttccacatattcaatcgtatctggtgaaacatctgcttgatgcagggcatcctgaatgacacgtgtctgtccttcgacgctcggagcattgaaaccaaccttttgatcaccatcattgttgatggcagagcccttaatgactgcataaatatggtcgccatcttctatggcttcactaagtgcttttaaagcaacaagaccaacaccatctccgccaacagttccatccgcttgatcgtcaaaggcgcggcagtggccatcacttgatttcaccatgttctgttgataaacatagcctgatttcactgggtgcaggattgacacacctcccgcaagagctacatctgaatcaccattcgcaatggattgacaggccaaatgcaaggcgaccaaagaagttgaacaagcggtttgcagcgtaagcgccggtcctttcaaattcaatttatgggcaattcttgtacttacggtgtacgtatcattgagtgaacccacttcaaacagctctgacatactgctatcaagggaagcggcaaaacgctgaatccattggaagttcgatgtggacccagtaaacaacccaaccttacccgtataatcttcttgcacataccccgcatcttctagcgccttataggcgtactcatgcaggagacgtatttgaggatccatcatttctgcctgacctggcgaataaccgaagaaggatgcatcaaataaatcaggtccatcaatgacaccttttgccctcacataatcggatcgttcgaaggtttgacggtcaataccggcttctagaagttcttcatcggaaaagaaggaaattgattcttctccattcttcaaatttcgccaaaatgcctcaacatttttcgcacctgggaatttaccagccattccaataatggcaatcggctcattggcttttcttgtcttttgttttacaggctgcgcgtctgccgctacttgctctgaatcgccgcttaaatatgcggcaagctctctaatcgttgggcggcggaacatttcgaccattggaatgctttgattcaattgcttagcgagctgttgattgacgtggatcaaattgagtgaatgcccgccaatgtcaaagaatttatcatggacacttacctcatctaaaccgaggacttttttccaaatgtcttgaataactttctccgtatcagaaagattggcagatcccgcctgttttttcgtttgctgcgcctgtttcaaagcaggtaaagctcgtttatctagtttgccatttgcagtcaatggcatatcgtccaattgaacaaagtgagttgggatcatataatccggcagttgatcagccaacgcttgttttattgccgcttgatcaattatggctgtcgtgacaacatatgcagccaaacatggtgtaccagaagcatctggctttacaacaactgctgctgcttttattcctggctgttcattcagccaaaattcaatttcaccagtttcaatccggtagcctctcagcttcacttgatcatcatttcgacctaaaaattgaatgagcccattagggagaatgcgcgctgcatcacctgttttataaattttttcacctggctggaaagggtggtcgacaaatctttcttcggttagttctgggcgattcaaatagccttttgcgacaccttttccgccaatatataattcaccgacggctccttccggcatgagattcatatgtctgtcaaacagaagaatatctgtatgctgtgcaggcttaccaatcggtacatacacgtcttgatcgagatcctgatcatatcgatgaatcatgcagccaacgaccgtttcagttggtccatattcattcacaatttcaattggctgcgggaaggactgctgaatggatttcgctaaagatgtttccagctgctctccgcctaaaatgaaacatttcatttggctgtctgggaaagacaaatgcttaataaactgtaaatgagatggtgtcagtttcatcacatgcacgcgattgtcttttatgatgtcttcgacaagcagctgccggttttcatggtgataaatcatgatggtatttcctgaaatgagcggcgtgaaaatagaagtaaccgtcaggtcaaaggacagtgaagtgtacaaagcaaaatgccttgtttctcctcgaacatatacttgcttcgcccattcaatatagttggctaagccaagatgatgaatgagtacaccttttggtcttccggtcgttcctgatgtataaatgcagtaggctgtttggtctgaggtgatggcttctgccaagttgtctgatggtccggtgtatagatccggctgcgtgatatcgattttttctccatgataggcgtaggtgagcccttttattgggtgagttaagagccattctactccgctgtcttctaatagatattctattcgttcctgcggatattcaggatcaatcggcacgtatgcaccgccagcttttaagatcgctaagcatgctatcaccatttcaatggaatgctctgctaaaatgccgacacgctgctcctgtttgacccctttgttttgtaaataatgtgcgagctggttcactctcttattgagttgttcatatgtaaccgtcgtatcgccaaactcaactgcagctgccgctggcgttcgctctacttgtgcttcaaataggtcaatcaccgttggctcattgctagatgttgctccgtcatattgctggaagaccgccaactgcttttctttctcttcttctgatagcagctgtagttgagcagcagttttgtgcggatgagcacaggcatcagacaggagatgaagaaaatgctgacaccacttttcgatttgctcagctgaaaagctgacggggttatacaccaatgaaaagtgcagctgatcatcaaatgcctggacactaagcgtgagatcgaattctgtctgctcagtcatctcaaatccacgaatacgaattggctgatcgtttttcgtgagcatttgatctaatggatagttttcaatgacgacgattgaatcaaataatgattgctctgcagtcattcctgcataattctttaaggcagatagcggggtatgttcatattcatttcttacagcgatctcacggctcacttcctgcatctgttcaagaattggccgttcctgttcgaatgagacccgcagcggtaatgtgttaatgaacagcccagtcatcttttcaatatgagggacatctgcatttctccccgatactgttgtcccaaaaacaatatcatcttggttggcatacttagatagcaaaactccccacagcgtatacatcacagatgccagcgtcacgtcatattgattcgtgaatttgctcaggctctcggcaatggacgtatccacttgatgttcatattgatgaaacacttctgaatgttcatatgcgccgcttgacttcggaagcagttctgcataactccagccgttgaaaacatttttccaataggcggcttgttcttcagtctgttgaaggtttttctgctgccatttgacaaaggattggtaggatggtctttgttccagaagaggtttgtccccattcgataagcgctcatatgcactcatccaatcgcttaatacaatcccaaggctccagccgtccaataaaatgtgatggaagctaatgagaacccaactgacttcatcattcacttcacataacgtcaggcgaaatgggacttcctgcagatcaaagcgttcttctcggttctgtgccgttacctcttctttcagcacatgaagaggctccttcgcttgtgtcaaatcacgataacgaatgtctggctgatgctgcttcatcacaatttgtactggtcttgcgatttcctgccatctgaacaatgttctaagcatttcatgctgtttggtgacattcgtccatgattgttcaaaaatgtctcgatctattggtccgtctatttcgatcagcagttgttcaaaataagctgttccgttcggttccattaaatgatgaaacagcagtccttcttggatcgtagtgatacctaacatattttcaatgttctgtttatccagcttctgcggctgtaaggccatgggctcatctcctttctctctaagaatgtttcacgaaataatggcgtaaaccatagttagcaataacctgctgctgaatttgcgaagtcccttcaataatttcaagcaccttcgcttcacgatatagtcttgaagctgagttttcccggctaaatccacttccgccatgaatttggacatttgtatttgtaatgtcaacagcgattttagaagtgaaatattttgcaatggatgtttctgtgatcgcatcaggatgattcgcttctctcatttccccggcctttagacataaagctctcgctgcatggagctgagtcactgcatccccgatcatgcctttgatcatttgatgcttgtacaatttttcattaaactgtgttcttttacgcgaatacgtgacaagagaatcaacagcttcttgtgcgatggcaagccctgcccaagcgacactgtatcttccatggtctaatgcaagtgacaccacatggttaaatccgcccccaactggtcctaagacacagtcttcatgcacccggacatgatcaaaggtcatttccgctaaatatgacgctcggttggccatcattcctgtaattctctcaatctctacacccggctgatctcgatcgacaaggaatgccgtgacttgttcaccgtctcttgcaatcacaataaagaaatcggcaatcgctccaaaggatatccactttttcgtcccatttaatacataggattgtccttccttttgatagcttgtttcaacatgattggcatctgaaccaatattcggctctgacaaagcaaaggctccgattttttctcctttagctaattcaacaagccagccttgtttttgatcttctgttccataacgaagaatggcttctcctacaagtgaatttactgtcaataatgtgcgtacattacagcaagcttttcccacttgttctgtgaactgtccatatgcgatcggatcaagccccagcccttgataggaagaagggatacctgctgccaagtagcctcgtttcgccatatctcgaatcagtgactctggcaaatgttccgtctcatcgaattcattggcaaacggacggatatgttcatcgcaatactggcgaatgtcttcaacggcattgatcgtttgttcaactgttttcatgaagagctgccccctgttgttttctctcaattaaggcgacaatgcgattgaccgtactaaaatgagcaatgtcgaggtcttcgttatctaattggaattgaaagtcatgttcgatatagttcactagtttcatcgcaaatagagaattcacaaagccttgttcaaaaatatgatcatcatttccaagctcaatttcctcatcaaataccactaggttttgctcgatataggctcttacttgttcgtgtaggttcatgatttaatctcctcgcttttcgcttttttattgtttggctgggtctttctgatttaattcgatattgacatctacgtattctgggaaaggctgtatcatgcttaaatcattttcaaacaagatatagccatcctcccccttctcaatttctttgaaattggcaaacttatatgtgatgtacatcatacggtttcgatcggtttgtttaaaatcagcgacaagccgctttcctcgctttttcgcttcttgcaaaatcgttgtgagtaagatggtcccgacaccacgagacatgacgcggcaagacataagcagcagtttgacatgccatgtgtcacctgtttcttctattaatgagagtccaatttttccataggaaccgaatttatcttcaagttcacagacaagcagcaagtgggaatctgattgacggaagaaatcaagctcttcataatcgtaggttttcccgctcgcatttaattgattggtacggacggtcaattcttcagcgcgttggaggtcttgttctcctgcttctgatatcacgaatttcatttgtaaagacgccaagaatttctcaggcggcccttcatatttctcttcttcctgctgccttttgtccgcttctaagtacattcttctgcgtcgtctagcatcttctgtgataaagactggacgcaggcgatcatcagtgagtaatgacagataatccactgcatcccagcacgtaatctctggatgaacagccttcacttcttcccgctcaaatggctgatcatcaataaagagaatggtatctttatgaatatttaggcgctcactaattctctctaatgaactagatttggcattccaatgaatctctggatatagaaagaaatgttcaattccgaaggcagaaagcttttccttcacggctgcttcatcattccggcttgctatagaaagaaggatgccacgcttatctaactctgttagtacttccttcatcgatggttttaacgtcacttcatctgactcaagtaaaattccatcccataatgtatgatctaaatcccagacaacacacttgatttgcttagccattggttattctcctctcacatgtcatattggaaaaagcccttgcctgattttttgccgtactcgcctgcatcaaccattttgacaagcagaggacatgggcggaacttcggatctttgtagctctcgtataaaacaagcaatgaattcaaaatcgtatcaagcccaattaagtctcctgtcgcaagtggtcccattttatgaccgaaacctccgcggaaaattttatcgacatccgctggcgtggcaacttgatcttgcaccgcccaaatcgcttcattgattgtcagcatcagcacacggttggaaacaaatccaggaaaatcatgcaccacaactggtgttttatcaaacgatttcaagaaaccttttgccgtttccactgtttcatcagaagtggcttttcctctaatcacttcaactaacgctttaagaggaacagggttcataaagtgcgccccaatgacattctcaggatgatgcataagggaccctacctttgtgatcgagatacagcttgtgtttacaaaatagatggtttctttcgcacaaatatctcgcagctcttcataaataggtttttttatctcccaatcttccgtcacattttcaatgacgatatgcgcatcatgtaagccttcaagtgaagttgacagctggatttgagacagaacatcctctaaagacaatgagattttcttctttcgcacaaattgaaccagttgataggtcttcttgattttttccagcgcttcgtttaacttttcttctgtgacatcaactaatgtgacttgatagccatttgctgaaaggtctaatgccatatcagcccccatgacacctgctccaatcacacctacgtgcttcgtgttcatttctccaacactccaattcgctttaaaatgacattgattttttctacgacttcatttgttaatgaatgaataaaaaagtgatctccatcgaattcgaaaaacgcacaatcttcgcttgtatattgatcccaatcctctaaatcaaacagcacagaaggcaaatcacgcgtaccataaaaaatagaaattggacaagcagctggaacgacttcatcacacaaataggtctccaaaagctgaaagtctgctcttaaaatcggcagaaagaaatcaagcactgcatggttatcagcaagttcctcaggaacgcctcccatcgcaatgatcgcctcttttaatttggaatctgacagctgatgatagactttcttttctggaatatgtggcgggaagcgcccagaataaaagacatggacaggctctctgtttaaccttgttttcattcttttttgtaattcatatgcaaggacggctcccatgctatgaccgaaaatggcatagggctctccttcttttaaggaagatgatgcctggtcatagagatcatctgcgacctgctgtaaatcggttagaacagactctgtcattcttgtcccgtgcccagggagttcaagggcatgaatttctatcgaccggtctatataagatttccacgtactgaatacggtacttgctccacctgcgtacggtaagcaaaataatttcacgatacgccacactcccttttgcatttcatttccaattcctccagccagtgtttttcatcatgaatgatttgttctaaagaagctttgatattggcttggtacctactagacatctcacctgaaaaaaggagtttcgctgcctgatgcctcgctttctcccattctgctaaaatacgttccatccatcccaccagctcaggtagatcgtctttgatgagattcagtcgatacagctccactttcttcgtattgatgatctgattgaaagacgccacgagcctctcaatatcatcccattgcgaaaactgctcataaaatgtttcaagagctgtgattcctttttctattgcgtctatctgaccatgcatatttctcaggaaataagtcgttttttgattaaataactcagtcgagagcttgtctggatcaaagtagaaagccgcataggaatgaaattgatcattcggctgaaaatgatcatgaaaggtgtcataccctttctgtacatctttaaatgacagcacttgatgctcgtaagacaaattatctaaatgccgattctctaatacgtgaaagatttgctgattttcatcgaatccagtgattaaaatggaatgacggctatgggttgtcaaatactcttttctgcctcgctgaacgtaagggtctacccaaacgattaccgggcggtcacatgtcacatcttgcttgaccttttcaatgaggttgggacaatacgccattttttcgacttgaatgccttgtgcattcataattttttctggatcgtgtgccgacatccagtcaatctgtagcaagccattctctgtaagcacgtaggcaaattgatcatttagtaagtatggagcaacttcttgattatgcagcttcacaattggaaaaaagcaattgaagaaacagctgcgataaaacaaatcattataaggatgaatgcccgaaatctgtttgacggtcatctttttttcctctctttccagcaggagatgtcaccataaatcctttgatgaaaccaatcgtacaaaaccaaatgaaaaacaaataataagaaatcgctaattcaatgagagaggaaggtccccatacaaaagtcattttccaaggcagcccattaaaggctagctgcgcaacaatcattggcaggagcaatatcccaattagcagcagcacccagccgctacttttcagccagacgcgcagtgacatgtctctgcgaactaaagcgccgttttttacacgctttttccacttgataaaacgaacgatagacactatttgcagcaaaatgaacagacatgtggcaccaaggctcaattgatcaatgagctgaaaaggatccattgatgactctgcttcttcatttgtacctgtgattgttttggcaattagacgtgccgtttgctccgtgtagctactattcatatttgctaacactccgatcgcaatcccttcttttggctggatcagaaaaaatgatgaatagtttgggttagagcctgcatgaaaaagcgagtccacctgctcatgcgccttttctatataccagccggcattgtaatagacatgcttcccttcttctgggacattcacagttaagtgatcaggattttttacaaagcgagaccaagttgaatcggtcaattgatattgcagccaagtccccacatcctgactattcatcacaatatagcctgcaggggtgttacctcgatattctggtgctttaaaaacatgcggagcaaggaattgaagtttaaatccttctgagacagcaccggatttcatccgttttagcccagcctcggtttggtcaagatgatgccttttaaatagctctttcatataagcctcatacgatgttcctgttacattttcaatgatgagaccaaggacatcatagttgatggtcgcatattcaaaggaactgcctggcttacgattaagctcgattgatttcagctgatcaactgtttttttcaatgcatcctttgtagtatcaggctggatcagcgcaatagattgaaaaggaatgccgcttgtgtgatgcattaattgctccaccgttaaacgctgaggctttccattgtatgttggaaaaaaacctggaatatagctgctcaccggatcttttaaatgaagttttccttgcttctctaactccacaatcgcaagagcggtaaacgcttttgatgtagatccaatttcaaagaaagtgctggctgtcacttgcttctttttctttcgatccgcatatccaaagcctttttggtacaccacttcgtcctttttcacaaccacaacggacatgcctggaatgcgtccaagctccatctgttgctctatcacttgatcaatggttttagatgaaatcgctgcttttgcatgtatccccccggcaaagctgcttatccataagatcgctaataaaaatgaaagatacataacatactgatttttcctcatgtaaataatgaatccatttcttcaagggacatatccactgtttcaaaatcagacggtgtaaattcgattccttctttctctaagcaatgctgtacaagacgctcaatttgctgttctaccgcttgcaatagctgcgtcatgtctgtttcacacagctgtttttcgctgaaagaaagatggaaaatcagctgaccacccttgatggtagcgaccatatcgatgacggttgttaatggattatccaatgacgagtcaatccccgatgtaaagtaagacatctcataatcagatgattgtttaagcacttgatcaatttcgcctagatagttaaaacgtaattgtggtgctgaatgacgaggaagctgctgattgatgagtgacaacagcccatagtctgcacctttatttggcacttctcgtatcgtttctttgacaacacgtatgtgatctgaaagagattcagacacatggacattcacagggtacatggtggtgaaccagccgaacgttctagatacatcgatctcatcctctacagcatccctgccatgaccttctaattccaaagaaatccgctcttgattcgtttgctgataacaggcttgcgtcaaggctgaaattaacagttcatgcggctgcgtttgatacgcttgattcgcttgattgagcaattgattcgtgagttccactgataatgcgttggttaatttgatttcgtctctgacatatccctcatttgaggaaactggatacagaggctgaatattttgcaccgctttttgccaatagctgaccgactcttttacaccctctgatcctgcatactgattcacccgctcggcaaatgtttgataggaatgggttttagacggaagtacttctgctgtaaccttctctgcatgcaataattgaatcaagtcctccacaagaatttgccaagacataccgtcagctaatagatgatgggcggcaaagatgagatgtgattgagaatcagtttgacatagcgctgcctgaatcaatggtccttgataaagatgagtccgttgcttgacctgatatcctacttcttgtaacgcttcttccacattctcttctgacagtgctgtgaaatcgtgtatcatcagcggaatctcttgaatgtgttcatcataatagagtgtgtttgttgcctcatgtacttttaaccttagtccgtcatggtgaatgacgagctctttgagagctttctgcacaatagtttcatccatctttttctttgaatgaacaatgatggattgatgccagaaatgttcatcttttaaccgctgggaccagaaccattcgataattgggatcgatttcacatcacccatagcttgctcttgtgagatatatatgacaggttcctgctgaaccacttgtgccatttctctaaaaatgggataagtaaaaagatccttggtttttaaataaagtcctttgtcttttaacttcgcaataaattgaatcgccttaatggaatctccgccaagctgataaaaatgatcagccggttcgattgtttcatgccctaagatgtcttttgctgtatttacgatgatctcttcaatgtccgctgtttccttggaccactcaacagctgtttccacttgagacagcaatggatcaggcagtgctgtccgattgatttttccgttttgagtgagcgggagctcgtctagtacaacaaaataggcaggtaccatataagctggaagctgatctgataatttctttctcagtaaaaaggacgtcgtctttttttcttttaattcaatataggcagcaagctgtttttctcctgattcatcggttagatcaataacagctgctttatcaacttcttcaagtgccatcaatgcaagttcaatttcaccgagctcaatccggtagcctcgcagcttgatttgatgatcaatccggccaatgtaatcaatctttccatcatttgctcgtttggcgatatcacctgttcgatacatgcggcggccgtttacaaatggattgggcagaaagcgtgattcctgcaaatcaggtctttgccaataccctctgccaacccctgcgcctgaaatatagatttctcccactgtcccaggcaacacagcttgctgattctcatctaaaaggtagatctctgtattgggcattggcacaccaattgacaccgatgtccctccatcatcttgatggaattgatgaatcatacagccaacggttgcttcagttggtccatattcattaaagatggatatccttccatcacttgcctctgtgattctttttgccaaagcggtcgataattgttctccgcccacaatcatccgtttcacaactgattgagaaagtgcagcatcagttaacagtgccatatgagctggtgtcagcttgatgacttttgctttttgatcaaacaaaatatgttctaataaaaagcctggctgatcctcttgacgatagatcaccactgtactgccaatgaccaatggcgtataaatggatgtcacagttaaatcaaatgcaatggatgaatacaaggcaaaatgatcatctggtgaatcagtatagtgtgttttagcagacataatatagttcactaagcttccgtgctcaatcatgactccctttggctgtcctgtagagccagatgtataaatcatatatgcgacgtcttcatcattcccagtgaatggatgttccggattatactgatccagctgattccacacgctgttgatattgtacgtatcgccattaaattggtatgcagatgcgtcatttgtgaaaaacagctttgcctggctgtcatccaaaataaactgaatgcgttcctctggatactcaggatcaatcggtacatatgcgcctccagcctttaaaatccccagcagcagcacaatcagttctggtgaatgattcatacatacggcaacaaagtcatgtctttgtaagccatgtgtttgaagaaaatgcgccatttgattggtttttctctcaagttcaccgtatgtcatgctatgagatccgtcctgaagtgcaatccgatcaggagaagacgttgacatgtttgtgatcaattcatggattttttgtttctgtggaaattgcacgcctgtatcgttccattgatatagctcccgatgttcctcgtcttctgtcatgagaagtacgtcttttaacagctgctttggctgagcgagtatgttttcgacaaagagaagcattctttcgtgtagaaagtcgatgtcttcattgctgtaatctgagatcttgtagtcatattgaagctcgatttgccctttttcatcccattctttcacagcaacttgtaagccatagggctggaagccattgtaaagctctatgtattcaactttgtatccttccatctcctgcaccatatttgtgctgtaggagttgatatagatttgaaaaagctgatcataccctgcttttgcaagctctaaatctttgacaagtgcatcatagggataacgctgatgcaggaagtaagccttatagcttttttgaacgtctgttaaactttctaacaaagatagatgaggatccatcttcattcggtatggcattgtactcacggtcataccggacgtggctttttccttttgtccggaacgattgagaactggcgtcccaataataaaatctttttgctggtatcttttatgcaagtaaatgaaaagtcctaaagtaaataaagagttgattgaacaatgatgggtatctataaattcatagattcgttctgagagttggcgatcaaggtaatggctttgccgatggcctttgatttggtcagttccctgtaccaaataactattagacacatcagataatgcttctttccaaaattgctgatcttttttaaatcttggggagttcctatattttgattctttatcaataaatacagaatgattgtctgcttcttgttcgatagaggagctttgggtaagagcagtgtaaagctggctaattttatcgatgattactttcatcgaccatccatctgctactgtatgatggcatttgatgaaataaccggattgttgttcaccgatttttagtaccgcaaattcggcgagagaggtttctgttaattgaaatggtgttttgaaggctttttcggcccattctagcatgtcttcatgtgtggaaaactcataggtaggaatagtgtgatcggcgtttgggtcaacgtattgaagcgtttcaccatctttctctattagcttgagacgaagtgattctgtcattatgatacaagatgcaatggcctgcttcagtttatcgagctgcaacggcccattgacgaaaatgatcccgccaatatgattgatcggtgtttctggataaaatgtttccatgttcatcacgcgccgctgcggatgtgttaatggccaatatactaaactactagtcaattacgccacctctacttttcatatagttaacatttcttacgaacatattaaagcatataatagtatttttgtaaataattgagataaaatgtctaaatttgttcattttttaatctagacgctaggaaggccgacacagtaaacagggcgacatttataaaaaagacgactcttgccccaaagagatcggtcatggtactcataacaagaatggacatcccgtatataaaagttgatagtgtatgttgagctgatagtattttgggcaattcaatttcactcagtgtatcttgtacataggtccgaatggaaatgctgcgaagctgaaaggctggccctaataaaaagacaaacaacaaactcatccatgcagaatgattcaatcctaaacaaagggttagcacagcaacgatcaccgaactgtaaaaaatgtgatcaaacaaacgctgttccacatgttttgcgaaccgcagtacgagcaggccgcctagaatggttccgccaaaatagcttgcgttaataaagccccaccatgtttctggctggtgtaagacttctgtgacatacacaagaataatggcaccagtccatatacttctaccactcatggatagcatttctaatatcgttaatgttcgaatagtaggcttagcatacatgagcttccatcctgaaaagacccttgtagtaaatgattcagactgttgctcttgtttagctgcagccccagtatcaatgataaagagcatagataggagcgacaaactgtataaaacaagtgtcgtcaataggagaaactgtggtccaagaatgccaataaacagccctcctaacagccagcctagtaaaaggaccatttggtcagaagttaagatataactattagcttttagtaaaaagttcttttctactaaacgcgggatcatcgaatttcgaacaggaatcgttcctccatctatcaaagaaaggaaaaatacaataataaaaaagaaaggaatagtaaaagttgataattgtagaatataaatgaaaatcaagcagccgaagaaagcaatttgacacatttgtaaatagataatgagtctttttagcttaaattgatacataaagaaaggaataagtaccgccccaagtgcttgtccaacaaactgcgagacagccaccattgaagcaatcagtgtagaatttgttaattgatatgtcaggatggttaaaacgaggacatataacgaatccccaaaattagctaaggattgtccccctaataaaaagtaaaatgatttgtttttcatatttgtctccattttctcttcattatcacccataataatacattattttctacacttctactttttataacaatatattcttaatttgatacatttttcctaatttaaaaaaccgccaaaaggcggtttttatttagtcatatatatggatggttggttctttgtcttcagcatttttcgtgatcaaggcttcttgttgatctgatgatgtgatgttaatttcgatattggtactcttatagtaatccatcacttcacctgttaaatattgcgtgaaggctacgacttccgtttttccgtagaactgcattggaatttcgactttcattttttgcaggttcccgtttttgtaaaagccttttcctacgacacccgtgtaattcgggaagtagtcttcgacttttgttttgaagcggtcaaatcgctcggaatcatctttgtagttgcctttcgcattatctgaagggaagaagacattctcctctttgatcgtatcccaattgccaatatcagctgagcctgctttcacatctgttttggcgataaagtttcctggcacgatagatgattttggtgcttgcttataaagggcaatcatgacaggcactttttgcagcccatccatttgacgaattcgtttgatcacttgttcagcaattttttcgccttctgacagtagtttctttgaatttttcgaagaatcgatcgtcacttcttgctgcggatcaccgatattttcacggtaataataaacagagttcagcgcaagtccaatgacaactccgcccagctgtaagctgtttttatcttttcgaattaagtaattatgctctagcatcgaagctaagtaaattggactattttcatttttagactttgttgaacctgagttcgggagagcaggatttaagcctaaattcttaaagtccttatcttctttttctgcctttttcagatcactgcctgtttttttgcgcgccagccagctgagaacggtgtcctcgtctaaatgctgtccttcttggaaaaggtagtcgtttgtattaaatgactctgttgcgagacgcatgagtcctgtttcaaattcatcgatgtccaaacgtgtgttgagacgctctgctgttaatcctctcgcagctccttgtttaaacggcagcaccattttgtaataagagtcagagatattgtacatcgggatgatggctgtttccttcgtttcatccgttttttgtgtgacctcttcctcatcctttcccccaaaaggtgcacacgctgacaataccagtgtgagcattgtcagcagcaataacaactttttcaatagaaaacactcctcttatttctttagctcctcgagcattttagcttcgtcccaaatttcaatattgagttcttctgcctttgtcagcttacttcccgctgcttctccagcaatgactaaatctgtttttttactcacactacctgccagtttaccgcctaatgcttcgatcgcttcttttgcatcgtttcgcgccatttcttctaatttccctgtcagcacaatggttttgcctgcaaaataggaatcactttcttcaaccttcaccggttttggtcctgtataggtcatattgaccccaagctcttttagttcatttagcagattgagtatttcttctttctcaaagtacgtgacgacagcatcagccattttttcaccgatttcatcgacttcgagtaattgttctttcgtcgcttgctttaattgatcgatatcgccgaaatgcatcgccaaggtctttgccgctttagagccaataaatcggataccgagtccaaatagtaaacgctctaaagagttttctttcgattgctcaatcgaacgcagtaaattatcgacagatttttcgcccattcgctcaagttgaatgagctcttctttcgttaatcggtaaagatcggacacacgagagacaagctgttcttggaaaagctgtgtaatgacacgctcgccaagcccatcaatgttcattgcattgcgggaaacaaagtgaatgagtccctcacgtatttgggcaggacattctggattgatgcagcgtaaagctacttcgccttcaattctcacaagctcactatgacactctgggcattcagtcggcatgtgaaacggcttttcttctcctgtacgctgatcgatcagtacgcctgcgacttccggaataatatcgcccgcttttttcacaatcacttgatcaaaaaggcgaatatccttttctttgatcaaatcttcattatgaagagaagcacgctgtactgtcgttcctgctactttgacaggctcaaggatcgccgttggtgtgatgacacctgtacgcccgacacttagttcaatatcaagcagcttcgtcacaacctcttcagctggaaacttgtacgcaaccgcccagcggggactttttgctgtaaagccgagctcttcttgctgtgctaacgaatcgactttgatcacaattccatcgatttcatatgaaaagtcggcacgcttcgttttcagtgtttcaatgagctcaatcacttcctcaatcgtttggcacgtccgtctttctttgttcgttttaaagccaagttcgtcgagaagatcaagtccttcgctttgcgattcaacaccaatttcatcaagctccgctatactgtagacgaaaatatcaaggtttcgtttcgccgcaatttttgtatcaagctgacgaagtgaacctgccgccgcattacgcgggtttgcaaacggctcttcttcgttttgtaatcttttttcgtttaatgcttcaaaagaaggttttggcataaatgcctcgcctctcacttcaattgacaaaggacgtttgattttgagcgggatggaacgaatggttttgaggttttcagtaatatcctcacccgttgtcccatctccacgtgtggcacctcggacaaacacgccattttcataacggagagaaacagcgagtccgtcaattttcagctcgacattgtatgagatatcgtcaccgactgcttgacgaacccggcggtcaaaatcaagaaggtcctgttcattaaatgcattcccaaggctgagcatcggtgtgccgtgacgcactttttggaaggcgtctaacacagcgcctcctactctttgcgagggagagtccgctgcttttaaatcagggtgctcttcctctaaagagatcagctcacgcatccgcgcatcatactcagcgtcaggaacacttggacgatcaagtgtatgatattcgtagttgtattggttcaaaatctcgtgcagttcctcgatccggcgtttcgctgcttctttatccatctgcttcttcctttcaattcatccgttttataagtcctatcggtttattgcttctcaattggcgcaaatgctgcgagaagacgcttaatgcctgtagggcttgggaaggcaatatcaagctctgtgctgtctccactgccttttacactgacaaccgttccaacgccccattttttatgagccgctttatcgcccacagcccagccaatacttccgccgcctgtgttttgaatggtttgagtttgcggacgtgagacaggtccccgtctttgcggtctttctcttgtttggccaaatggtgtttttgtttcttttttctcatttaggttgtccaataaatcggctggtatttctcgaatgaatcttgattcaaggttcatgtttgtccggccgaagagtgttctcatcttggcacttgataaatagagctcttcttccgcccgtgtgatgcctacataagcaaggcggcgctcttcttccatctctgcatcttccattaatgaacggctgtgcgggaagacaccttcctccatgcccattaagaagacaacagggaattctagaccttttgcggcgtgaagcgtcattaaaatgaccgcatcctgatcttcttcctcattttcatccagcttatcgatatctgcgacaagggcgagatctgtcaggaaggtcacaagggacttgtcttcattttgttcttcaaagttcttagtcacagagagaaactcgtcaatattttctagacggctttgtgcttcaattgttttttctgccttcagtgcttcacgatagcctgttttctctaggatttcttctgttaattctgtgacagataaataatcctgcatatttgtcatttgatcaatgagctgtttaaattcatcaagcgcattggctgcccttgcactgagtccaatgaaatctacctgagcaagtgcttcaaacatagacaggtcattcatctccgcatatgccgcaattttatcaacagatgtagcaccgattccgcgctttggtacgttcacaattcgtgcaaagctaatgtcgtcatctgggttagctactaggcgtaagtacgccaaaatgtccttgatctcttttctatcatagaacttcgtgccgccgacaatgttgtattgaatgtttgacttcaataatgtttcctctatcacacgagactgagcattggtccgataaagaatcgcaaaatcggataatttacgcttgccactctgatgaagctgatgaatctttccagcaacaaattgtccttcaccgaattcattatctgcacggtaataggcaatctttgctccttcatcattttctgtccaaagatttttcggcttacggtttgaattgttttgaatcaccgtgtttgcggcattcagtatgcgtttagttgatctgtaattttgctcaagcaaaatcacttcactagaaggataatctttttcaaaggagagaatgtttgtaatatccgctccacgccagcgatagatggactgatctgagtcaccgaccacacatatattttgaaaacgttgagcgagcagtttcacaagcatgtactgcgctctgttcgtatcctgatactcatcgacatgaatgtattgaaattttcgctggtagtgttccaatacttcagggatgcgctcaaacagacgaatcgtcatcataataagatcatcaaaatcgagtgattggttcttgagtaatcgtttttggtaatctgtatagacgtcgctgaccacttgatcatagaaatcaccggctgttttggcgtattcctctgcgtcaatgagttcgttttttgcactgctgattgaacctaaaatgctgcgtggatcaaactttttaggatcgatatttcgttcttttaaaatgtttttaatgactgaaagctgatcagacgtgtctaatatagaaaagttgcgatttaccccaatacggtcaatatcgcgtcgtaaaatacgcacacacatgctgtggaacgtagagatccaaatgtcatccgcaccaggccctaaaatggcttgtacacgctcacgcatttcacgtgctgctttatttgtaaacgtaatcgctaaaatgttccacggagccacatgcttttctgccattaaataagcaattcgatgtgtgagcacccgtgtctttccgctccctgctcctgccatcaagagtagcggaccgtctgttgctttgaccgcttctttctgcgcgtcattcagcccttctaatagatgattcgatatttcattcattccattcaccgccaattcgaacttatgttctattttaacccgtttcgtcttgtttgactatgatgattttttgactgcgctcactgtctttaatgcttctttgaaattgtcataaatgacgtttcctacaacaaccacgtccgcatgctgcgcaaattcttctgcctgtttttcgttttcaatgcctccgccataaaaaagaaccgtatcagaaagcactgctttcgtttctttcacaagctctatatctccaagcgttccgctgtattctagataaaaaatgggcagcttcatcaaatgctctgccactcttgcatatgctcttacgtcatcgatgtccagcgctgtatttgcttctgtgagcttggccgctttacattcttcatttaaaataacatagccttcaggaacgatctcttccattgacatcaaatcaccgaattccttcatcgcgtccttgtgaagcccaacaatccaatcagggtgagagctgtttaagacggtcgggatgaaatacagatcgaagcccggcacaatcatttcatgtgttgagatttcgagcacacatggcacaagaaaccggcggacctttgacatcaactggagcacgttgtcctctgtcacattgtcactgccgccaatcaatatagcatccgtaccagattcacaaatcgcttctagctgttcatcggatatttctttatttggatcgagtttaaagacgtgcttccactcggtaacatcatacatgaaaaatgttcctccattcgtttcattccatttaaatattataacaaaatcagtgaccgcaaaaaatgggtaacctccttcagctaaaagtttcattcttttgaaaatggtgttcgtgactttaggatagaatgctgaaaacatctaggagctgcgagggctgatctttgaccgttcactgataggaaaagctttttatcaccacatgttattatacaataaagggacattttactattgatcaaaaaaccatacataaagcaggtgatctacttgaaaagaaccatcacatatgatcaaacgatcgacatcggatacatctatctcctgcctgtgggaatcgggacaatcaaagaaaccattgaattagatgtgaatgaatgtgtaaacgcagatatcgacaaagagggccgagtagctggtctggagttattcgcagaagaagccgaggttttgaagcatgcacccgtttatgaggatgagctttcgttacgttttacagatcaggacgttctctcaacctttcatttatcaggcattgaatttcatttctcgacgcctgatcacaaagggctgatcggttttacgattgtcgatccacttcgatataacttcaaaagaaagacaagaaaaaaccgttttgaatggtcaaaacggtttttccaaactattgtctcacttcattgaaataatggacggatgtcatggccccttcatcgaccattttgttgtcttgaatatctaatggatcagggtgtccagctttttcaggaatcttttcatctgagcggaacatgcttgcccattttttgagatgctgtttatttttcactgctaataacactgcaccaccaacccctaatcctgcaagtacatacccattcggacgcttattcatgtatgttccctccccttatgatcttatttgtaagttaccccgccttttcatttctaaacgtcacaatctgttgaagtggtttctctttcaatgaaaagtggaataacaacagcaatgatagagaaaagaggggatcttcgtgacaacaactttcattgtcattggcgcactattagtaatttgtttcatcataccaatcattttattcatctggatttgggtgcgagatgaaaaacaggaagagcattctgtcctgcgaaattatccggtcattggaaagctgcggtttatttttgaaaaaataggacctgagcttcgccaatatctgtttctgaatgatcgggaggaacttcctttctcaagaagagaatacgagcaagctgtcatgtctgggaagtacaaaagccggacgatgggctttggatcaaaacgtgattttgacaagcctggttactacattcgcaacgtcctatttccaaagcagcgagatgagttacgcatcgatcaatctgaaaaaatccaaacaaaagtgtaccagattgatcaagacaatttactgcgaagaagtgaacataccaaagaggttgaagcaaaaccttactatctccatcaagaggatgtccaagtgattggcgagcacacatgtcaaaagcctttccgtgtaaaaggcctgattggacagtctgcaatgagctacggatctttaggcgacagggccattacagcactatcctctggattaaagatggccggcggtacgtggatgaacacaggtgaaggcgggctttctccctatcacctcaaaggcggagccgatatcatatgccaaattgggcccggtctatttggcgtgagaacagaggatggcgatttttcctttgaagaatttaagaaaaaaagcgagcatgaggaagtcaaagcctttgagctgaaactggcacaaggagctaaaacacgcggcggtcatattgacggcaaaaaagttaccgaagaaattgcgaatatccgtcaattgccgccccaccaatccattgacagcccaaaccgatttgagatgttccactccattccggatatgtttgatttcattgaacagctgagaagtataggcggaaagcctgtcggcatcaagcttgtggtcggacataaagaaaacattgaagagcttgcggcgtacatgaaaaaaagcggaaagcatcctgatttcattacagtggatggcggagaaggcggcactggtgcatcctttcatgaattggcagatgccgcagggctgccgattttcacggcactcccaatggttcatcaaatattgaaggaatacggtgtcagagatcaagtaaaactctttgcttctggcaaacttctctcacctgataaaattgcaattgccctttccatgggtgctgactttgtcaatatcgcacgaggactcatgttttcagtcggatgcattcgcgcccaagtgtgccacacgaataaatgcccagtcggggtcgccacaactgatccaaagctgcaaaagggtttatcaattgaagaaaagaaataccgagtttgcaattatatcctttctctaagagaaggcttgtttaacttatccgcagccgctggaattgaatctcccattcattttaatgagaaacatattgtctatagacaagaggatggtcagacaagtgaagtgcctatttttacaggaacacagccatccgtatagtttgagaaaggtgcgtttttgcacctttttttcaattgacattttggctcaattgcgtataaagaacttagagaactgaccaggaattggagagatggaggatgcgtgagaaaaaggttcgcgggatgaaacggaagacgaatgagatggtgacaagaattgaggaaagtacacgagagttcccggcagatattgaacaaagttattggcatctgcctctaccggttgcttatgattttatttgtacaagcaaaacacctcaaaaaatcaagcgattgtccatccagacactgataaatagagctgaacatctcattgatttgaagccaattgatggagaagtatatcgcgttgtggttgcagtagatgccactaaattatggggttcacaaatcattgtgtttaaaggagattcctattttaaagactttttcaatagacatgatgatgatcagagttggctgcctctttccggtgccagaaacattcaaagggaatggggtttatctgtgccaaaggataggcaaatcataggttttaaagacatcatcgctgacgaagatggcatctcttacgaaggcgaaagatggtttatcggcgagctaaaataaaaaacaggacccgcttcactcagccagtccttgtttgtcttttcagcgctcttcataaaaaaactgtaaacaactctattcttgttgaaaaggattgtttacagtgaaagctgctttattttgtttcgtcatttgtctgctgttctgctacgcggtcaagtgccatcgtataggcatcatttccatagttcaagcagcgtttgacacgtgagatggttgcagtgctcgcacctgtctccgtctcaattttatgatacgtgttcccctcgcgaagcatacgcgctacttcaagacgctgtgataaagattggatttcattgatggtacacaaatcatcaaagaatcgatagcattcttccaggtctttaagggataagatggagttgaataactgatctaagcttttgccccttaatttatcaatttgcatctttatacatcttctcctttactattggcaccgcttcgcacgacaatctgcggagaaagcggtatctttcctgactaatttttttcaacctcagcaatgagctttgaacgaatcatgacaggtttggttatacgctggaaatgccgtcagttctttcgtaagccgaagcttctttatcgtatacaaattcgacaagttctgtcattttccttgttcgacaatctgacaaacttgtttgcttccgatatcaagatcacttctgcttaattaggtctgtcctaaaaatacaggctgtgcggaaagctcggcgagaccacaaacatgcgccccgcctcgctcatcaattattcaaaatatgttggtcggccagcgtaaccgacagattcatttttcaatcagggcatttcactcgtcatgtcaaagccctctgcttcaacaactccacataagcattttcacttacatgtcagtgaagagatccactgctcacgtctgacctataacagctgtcagaaatgtggcaaagatgatacagctccactctgttatattttaacgcattatagacggaaagagtacagtttttttcatgacatcaaatattcctcttggtgtcactcgaatatacggcaaatgtgtactttggaaaaagacaagtgtatcaattgggcaatcaaacggatagcctcgctcaatgagcagctcgcgtaaggtttgtatctgctgaagaacagtctcaaacggttcagcagatgcacagcctgataattgcagcggaatttcgtgcaaaattttcccgttctctgtgaggacgatccccccgccgatttctttcattcgcttatgtgccagcatcatatcttctttatttttcccgatcaccaaaatgtcacccgtgagcgaaaatgagctgacaaacccttgcactttgtttgcaaaccctttgagcatcgtattcacacgccactcgccttttcggtcaatcaggctaaagaaactttgatcatgatcacatgacagctgattcacagagttatcaatctccactgtataaggctccatgatgactgcatttctcattttgacacctagcggcatggaaaattgcaaatcactcgacgttagatcgtagcctagatctaatggaacaagcccgccattttcccattttgtttcatgaaattgatgctggttctcgccatctaatttgaggataacccctttagatatgaccgtttcaggatttggattcattgggtcatctaacacattcaaagaagccaatcggccaggaccgacaacacctaataggtcatcaatttgatagtatttcgcaatgttaaaggtcgccatattgtatgcatcgatgataggtacgccttcttcaagggcaattgaaatcaaacgattaatcataccctcctcataaaaatgaggcgctgctccatctgttgtatagaagaagtgatcatagtgtctaaaatcacgctcgtgcagctctcttagaatgttcactaaatctgggcggatggaagaatgacgaagtgagacatggtagccaagggacaagcgttttagcacatcgtctgcattcatcgcttcatgatcgctgtccgcgccaaacagcttcatttttgttagcgttttctcagaagctccggggaaatgcccttcaattcgtttccgctgcttcttcgtttcttgcatgcaatataaaatgagatcatcaccgtccatcaatcttggccagcttgttaattcgccgccttgaagaacgtcaggatgatcaatccattccttgcgatagttgataggaagcatctcatcttcatatctgacctcggtttgaagatcgtatctagaccaccagaaatactgaaatggctgctgttttaattcacatagagtggaaagcgctttcttttcattactctgcaaaagaagaaataagttatcactgaccattgttgttgtgccaaattgagacacatattctgcaagtgattggggattataaatatggaacggatgcgcgtgaggctctatatacccaggcacaatgtatttcccttcacaatcaatcacacgtttagctgatttattttgaggaagctctgctccgacataaacaattcgatcatcatgtatccaaatatttgccttcacccattgttttaaaaacgggtttagcacgagtccattcgttaaaaggagtgttggaactatttttgagtcgactacatcgatttgtgtgcggatgtcattgtttctccaattaaaagtacgttcggacattcacatactctccttcatttgtattagccctatcgtaacataacgaaccacgttacgcattaatgaaacgttacaatttcttgaaatcacacttaaaatattttaaaaaggagatttaccttcaatgaaacctaatctcggcttaatggaagcgctcattcgaattgcctgtggaatgacaatatgtactgtggctggttctttatatgctagaaaaccatggagtaacatgctgcttttcagcatcatgtgcggcgggatgaaactggcatctggcattcttcgcttttgcccagtgacgtatatgtgtgagcagcaggacacacataaagagaaggctgattgaaacagccttcttttttatgatttccacctctgtcatcactctgctgcttcacaccattccaccatcgtacctgcgataatttctgcggcttcaataacatgctcaatgtcgatggattcattcggaaaatgggcaagctccgttgttccaggtccaaatacgatgatcgggatacctgccgcctgtgacagtaatccgccgtctgttccccaaggagcggcttcgatctttggcggctccttcttgaccgcttcatattgttccttcaatagatctaaaagtggatggtcagtatcaattgagcctggaagccatcttgcaccaaaccattcgacctcgacaggatgctctttgaaccattcatccttttccccaagtcccatcatccaattttctaattccttctctgcctgctcaaccgtctcccctggcatcacaccaagtctgccctccattgtgaccagatccgctacagaggacggccagtcaccgccttgaattttccctatgttgatagggattggaatcgggatatgctgaaataacggctcggtgatgcgctgatttcgttcttcttcaagtgctgctatatgcgaaagaacgatcatacttttttcaatagcggaaacgccgtgatatcttgttcctccatgagctgcccttcctttaatatgcagtctgaaccacttagatccctgctgaatcggaaagattttcatatgacttggttctggaatgatggccgcatctgctgtataccctctcagtatggctgcaagggtgcctgcaccgccgctctcttcttcgacgacactatgaaacacgacatctcctttcagcggaatctggagcgcatgcagtgcttctagtgcaaagagtaaagaaacgtttccgcctttcatatctgttgccccgcgtccataaagtctcccgtttatgatatgcccgctgtagggtggatatgtccattgtttcgtatctcctgctggcacaacatcgacgtgcccatttagtaaaatggatttgccgcccccttttcccttcaatcgtccggcgacattgggactttctttaaaggaacgcctcggggaatagaaatacggatgttcgagcaggtcttctccgccaatgtcccatacatctacatcaaaaccaatggcggacagcttatttgctacgatttgctgcacaccttgttcttttccttgtgtgctctcacattgcaccatttgctgaagaagcgcaatcgcttcatcttggtgctctctcatccagcttctgatacgtgtgattggctgcaagtcattcatcctttctacacaacagatttgacatcaggcgctaaaattaaaggtgcctctgtcgcccttatgacatcttccggctgatacggcggcatgacttcacgtaaaatgagcagctgcgatttgacctcaatgactgccatatccgtaatgatcagatccacacaagacttagcagttaaaggaagtgtacaggctgatttcacctttgactcaccgtgtttatcgaggtggctcatcaccaccacaacttttttcgccttttgcgcaagctcaatcgctccgcccatcccaggtactcgtttacctggcacaatccaattcgcaagatcgccctgactgcttacttcaagtgcacctaaaatggtcatatccagcatgccttttcgaatgatgccaaaagcagtcgtgctgtccatgtatgagccgccttttgttaacgtaataggaaagccgctggcattgcacaaattaggatcttcttccccttgtactggtgaggcgcctgcccccataatgccgttttcagcatgcagccatacgttgtaatgcgctggaatgtaatcagccgcaagggttgggatgccgatcccaagattgacgatcatgccatcttcaatttcctgcgccgcccgtctggctatgcggtgtcttatatcgttgtctcccatgcccatgtccagttcactccttttgattgcacaatctggttcacaaatacgcctggtgtcacgatttcctctggatgaagactgcctacaggcacaatctcttccacttccgcaatggtccagtctccagccatcgccacaatcgggtttgtattccgtgcacttttatcaaatatcagatttcctgcttcgtctgctttgagggcattcacaatggcaatatccgctgtcagcgcaggctcaaggatataggtctttccgtttaacggcacgagctgcttctcatcgagattgaggctatccatgccgacatctgtcacaatgcctgccaagcccatcccgcctgctcgtattttttctgctagaatgccctgcgggtaaaaatgaacgtctagtgtacctgcctgcattttctgtccggctattggatttgagccaatatgagaagcaatgatcttcttgactcttccttctgtgatcagccggccaacacctatttgcgggaagcctgcatcgtttccgatcaatgtcagatctttgatattggcttctaaaatggcctcgatcaatgatggcggcgaccctacgccgccaaacccgccgaacatgatggtcattccgtccctaaaatgcgtgatcacttcatctacattcactgttttgttcatcatctttcctccctacatcgcagatgggaaaaaccccctgttaatgacttcttgttcgacctgcgtgattgtctgctcaaataattgaatgagttcatccatctcctgctgcgtgatagaaagcggcggtgcaatcatgaccgctgcacctcctactccatcctcgccagcgcttgctgggtatacgagcaagccgttttgcttggctgtctcaacgactaaatgcgtcatttgagcatgggcaggaaatggggttttcgataagcggtctgcgacaaactcgatgccaatgagcagtccctttcctctcacatctcctatgatgaaatggtttgtttgtaaatcctttaatgcattcattaaatagcggccagacagatccgctcgttcaggaagctgatgttttttcatatatcgaataacagccagtgagacggctgctgaaagcggattgccgctataggtatgacctgccatcacagatccggaaccgctcagaatcggcgcgatgacatgatctgctgagacggctgccgcaatcggcgaatagccagcactcatccctttgccgagaaccataatatctggaacaactccccaatgctccatcgcaaacattttcccagttcgtccaaagcctgtcatgacttcatctgcaatcattaaaatattgttttcctcacagacacgtttcatggcttcaaaatatccgtctggcggtactagcgccgctcccgatgctccgacaatcggctctgcaataaaagcggcaatcctctcttttcctatacgctgaatgacggtattaaattcctggacataccattcaacctgcttgccctcttccttcggcagccatgaacgatagctatatggcggagacagcactggattcttttcgagcaatggttcaaagcgctctctccttgcaatatgtcctgacatcgacagtgcaccgagggtgatgccgtgataactcatccatcgtgagataatgtgattcttctcagcctttccctgctcctgccaatgctgaatagcaattttcatagccgtttccgttgcctctgaaccacttccgacaaaaaaagaccagttcaggttacctggacaaagcgtactcaattcataagcaagttcttctgctggttcatttgtgaattgtgatctgtacgtaaagctcactttttccgcttgctcagtcatggcatcaatgatttcacgtatgccatgtccaatacttgccgtgacagcccccgatgagccatctatatatttttttccatcccgatcatataaatatattccctctcctttcacagccacaggataatgctgattcaatatcggtttgattaagtaatcccggatctccactttgccattcctccctctctcgtcagcagctgcctctttctttttcatgaatcgcaagaaaattttgtatacttgttataagattagcttaatcaagagggcagtcatcctccattcgccacatgcccgaatttcagacgcattttttatacatcgtgtataagagtgttcaaaaggaggtcatgagcctatggcgattctcgtcaaagatgcactttcgctcgatatcatgaaaggaacaaagctgcttgctggagaaaatggactggaccgactcattgagtgggtgaccatcgttgaaattatcgaagacacgtcgaggctttccgatggggaattgctcgtcacaaccggattcggactagcggacaatcaagaaagaagcgaccggcttgaggaattgattcaatctcaaaggctatcagccatcgctatttataaaggtgtgtacttaagtgacattccagcttcactcattcaagcggcgaaaaacagcggcattccgctcattgagattccgccgcacatcaacttctcagatattacaaaagccgtcttagaacaaatcgtgagtagtcagcttcatcagcttaaatattcatccgcgattcatcaaagactgacccaattaaatgtaaggaataaaaatgtaacgcaaattacagaggaactggcacatctcactgcagcgaacattgtcgttcttgatgtctttttacatcaaacagcggctcatctcatcaaagatgaagtgacatactctcctgcttttggctttttgacagatcatgaaccaattgataccatgccccttctcaagcaggcagaggagaaagggcggctcgtctatgacacgtgcggagcgttcgtcctcgccgcatgtccagtgattgcgatgggtgatatttttgggtttattgtgtctttaaagaaaaaggatacgtggcatcatctcgacgcgattgccatcgagcatgccggggcagtgtatgcgattgaatggttgaagcaaaaagccattcaagatacagaaaaccaaatgcagggacatttgttagatgatattttgcagcagcaatatacagaagaaagctacgtggtcgaacaagcaacaaagctgcaatatgatatgagcgatgagcaggtggtgatctactttcaattccagcatcagcacacacagctcgatcaccaaatgatgcagcgtctatcgcaattactcacttcgatctttgaacgcagacatattccttttttgctaaagacaaggctcgattccatttttgtcctaacaccagcaggaaaaaaagcgtttcaagaagcggagtggtatcgcgcagcagaggaatgccggagcacttggtcttattttttccccgtccatccgattgtcattggtatcgggagagcctatgaccagatcagtctctttgcaaaaagcgcgaaggaagcgcagtatgcagctaggcttcttccgcttttaaaaacagacgagagcatcattcattatcaaaagctcggcttatatgggatgcttcttgaaatgaatgaagcgggtatgaatttgcatgatttttacgtggagctgttaagtccgttgctatatacgaaaaagcaaggggctgacctgattcatacactcgaagtgtatttggcgcacaatgaaaatattcaaaaatctgcgggagaattatttattcatagacatacgttaagctaccggctgaaacaaattgaaacgagaacaggctgcagcctcaaatccactgatgatcggatgaagctgcagcttagtatcatggcgtaccgcctatctggtctgcttgatcagatgagaaccatttcatgattcatttggcgttttaacccatagattcatatcttcaattttgtcaaaaatatagcagttgttttgaaagcgaccggtgtacgtatatccgagctgataaaatacttgattcattccataggacagtgcacgagcaagagaataaaagacatagatatgcatcgactggagttctttttcaagggctagaatcaaatgatgcatgaatcctagttttctatatgaaggaagggtcgcacagtctgttaattctgcatgaccatacggcgcattgatctcagcggatgctgcactcacaatgtgtccgtcatgttcaacaacataaaaaatggtcccttcctccattaccttttgaatataatctgactcgttcattggcgtagggtacgtttcaaagacggtatcatagagctttgccagcttgtgaatatcctttggatcggcttttctcatcacatactcatcctgccatgtgccttggtcttttttgattacttttgcttgaatggatgcgacgatctcatcttcctgcagccaatacgaactgttcattcgatcctcagtgagaaaaagcgacataccgtaagcgtcacttccaaggaaataatgagaaaacaccccttcaagccgaaagcctttttctaaaaaaagcggcacatgctcacgtcttactttcacaataaccttagaagccttacagtccgtcgcttcctttagaaccgactgaatcacatcccgcaccctgccgctgtagtcatccaaacggattcgctcattaaatgaatcaatacagatcgaggcagaaaaacgctcgttcgcaagttccttcaattgcaccatacactcattcctctctaatgaattagttaataaagaatgtccaaattagaaatgacgaaatagcgatgccagaaaaaattgaaagtatcatatataactaatggctgaagcttttttcattttattgtgcttaatggcaatcaacatgatgttatttatagttatgagaaataaaataagtatgacgattgcaaagataataaatgctttgatttccatgtttcctcccaatatctattcgtgatcccatactacttcttcatattcaatcggcatcccttctcatgaacaaaaaacacctttccatctcatcagatagaaaggtgttttgattaaacggattttcccgcagccttcagcgcacgggcgccaatgtcacggcgataaaatagacctggttgaatgatttcttcaaccgcttcatacactcttgatcttgccgcttcaaatgtgtcgtcaaatgcggtcacatttgctacacggccgccatttgtgacgaattgatcgttttctttttttgttcctgcatggaaggtcacgacatcagacaccgtcgtttgcaaagcgccgattggcgtaccttttgcgtagtcctcagggtatccttctgaagcaagaaccacactcacagcggcagtgtctttccactgtaagtccacatcttttccgtctagaatatcgaggaaaacttgaactagatctgattcaagacgaggaagaaccacctgcgtttcaggatcgccaaagcgtgcgttgaactcaatgacttttgagccttctggtgtcagcattaagcctgcatataaaatgcctgtaaacggacgctcttcctgcaccattgcgcgagccgccggtttgacgacatcttccaccgctttttggacgacttcatctgaaatttgcggaactggtgaataagcgcccatcccgccagtattcggtcctttgtcatcttcaaatgcacgtttgtgatcttgcgcgatcaccattgggtacaccttttctccattgacaaaggccatcaatgaaaattcctcacctgttaaaaattcctcgatgacgacagatgcactcgcatcgccaaacttttcatcctctaaaaagtcatgcagacagctgatcgcctcttcaagtgtcattgcgactgtcacgccttttcctgctgcgagaccatcggctttaatgacaatcggcgcacccttttcttccacatatgccttcgctttttcaaacgatgtgaaggtcgcataagcggcggttgggatctcataatttttcattaagtcttttgcaaattcctttgagccttcaatgactgcggcttttgcatttggaccaaatacctttagacctgcctcttcaaatgcatcgacgacacctgcaattaaaggaacctctggaccgacaatcgttaaaccgatttcattgtcttttgcaaaacgaattaatgcctcatgatcaccttcgtcgattgggacaagcttcgcagcatctgtcattccatcattgccgggtgcgacaaatacttggctgacaagttcactttggttcactttccatgcgatggtatgctctcttccgcctctgccgataattaatacgttcacactgtcatccccttaatgtttgaaatgtctaacgccagtgaagaccatggcgatgccgtattcatctgctttttggattgattcttcatcacgaatggaaccacctggctggatgatcgctgtgacgcctgcctttgcagcagcttccactgtatcgcccattgggaagaacgcatcagagcctagtgcgcttcctttcgctttttcacctgcttgctcaatcgcaatatttgctgagccgacgcggttcatctgaccagcgccgatgcctgctgtcatttgatctttagcgagaacaatcgcatttgatttcacatgcttgacgactttccatgcaagctttaagtctttccattcgtcttctgtaggttctcttttcgttggaatagagatcgttgcttcctctaagccatacgtatcaatatcctgcacaagcagtccgccatgaacacttgtcatctgcttttcttttttcccaagatctgcttctacatctaatgttaatagacgaaggttctttttcgctgttaacacgtcaagcgcttcttggctaaacgatggagcgatgacgatttctaagaaaatcgtatgcagcacctcggccgtttgcttgtctacttcacggttaagcgccacaatgccgccaaaaatagaagtttcgtctgctttgaatgctcggtcaaatgcttctgcaatcgtttctcctgtaccaacgccacacgggttcatatgcttcacagcaacagccgctggctccgtaaattcacgtacgatttgaagagctgcatctgcgtctttaatgttgttgtaggaaagttcttttccatgtaattgcgttgcagtagctaaagaacctttgcttggaagagcattttcatagaaagtcgccgcttggtgcgggttttctccataacgaagggattgttttttctcaaacgtgacggtgaactgctctggctctgtttcgccaacaaaattcgttaaataatccgcaatgagggcatcgtaagcagctgtatgacggaataccttcgccgcaagctcacgttttttctcaagtgacacgccgccttctttgatttgctgaacgactgtatcataatcacgagggtcgacaatcactgtgacgtcttggtggtttttcgatgccgcacgaagcattcccggtccgccaatatcaatgttttcaatggcttcttcatacgttacatcgtcttttgagatcgtctctttgaaaggatagagattcacgacaacaagatcaatcggctgaatgccatgcttttcaatctgtgccatatgctcatcgttttctctcactgccaataatccaccatgaatgttcggatggagcgttttgagtcgtccgtccatgatttcagggaatccagtgacttcagaaatcccaatgacatcaatgccattctcttgaagaagcttatgagtacctccagttgaaatgacttcaacaccaagttctgttaattctttcacaaaaggtacaagattcgttttatcggaaacactgattaatgcgcgtttgatcgtcatgccttcgtcacctcattaagataattctaaaagtgatttgatcacttttggatatagtgtgtgttctagttcatgcattcttttttcaatcgattcaagctcttcaccttgttcaatataaatcgcggcttggtcaataatcggacctgtatccatcccttcatcgacaaaatggacagtgatgcctgccactttgacgcctgcttgataggcttgtccgatggcatcaagacctggaaaggctggcagcaaggatgggtggatattcacgattttccctctgtatgcttcaagtaatgtcgggccgatcagtctcatgtaccccgcaaggaaaacccattctacttcatgaagcctcagttggtcgatgatcgtttgttcaaaagcggctttatttggaaaagccttcggggtaaaagcaaaggagggaatgccttctttctcagcacgctccagcacctttgcacccggtttatcacaaatcacaatggcggcctcagcctgccacttttcttgttttaacgtatctataatggcttgaaagttcgtcccgcttccagaggcgaagatcgcaaacttcttcatgagaggcttccaccgccgaatgtgacaccttctcctttttgaacacgtccgatgagaaatgctttctctccatcctgttcaagctctctaatcacattaacaagatcgtcctcttttacagctaagacaaagccaatgcccatattaaacacgttgaacatctcttctgcctttaactgacctttttcttgaataaaggaaaaaatgggtggtactggccatgagccgttatcaatctcaacgccaagaccttcaggcagcatacgtggtaaattctcaataaaaccgccgcctgttacatgtgccatgccgtcaactttgccggcttttacttgtttgagaacgggcttcacataaatttttgtcggttcaagaagctcttcaccgagcggtcttgtaaaaggtgcatacgtttgatgcagatcaagaccagcgtcttccagcaagactttacgaacgagagagtatccattgctatgaattccgcttgagctgagtccaataagcaaatgtccctctttgatgctgtttcctgtcacgatttcgtccttttcaacgacacctaccgaaaaaccagcaatatcatattcttcttctgtgtaaagacctggcatttcggctgtctcaccgccgacaagtgctgaaccagactgctcacatccgtcagccacacctttgacaatggattcaatttttaccggatctgcttttccaacggctaagtaatctaagaaaaagagcggttctgccccctgtgcaagcacatcgttgacacacatggccacggcatcgacgccgatcgtatcgtgtttattcattaaaaaggcaagctttaatttcgttccgacaccatctgttcctgaaacaagaacgggctttttgtatggcagctcagatagatcaaacataccgccaaatccacctagagcgcccataacacctgctcgttttgtacgttcaacgtgtgttttcattcgtttgacggcttcgtaccctgcttcgatgtcgacaccggcgtttttatatgcttctgacatcccattcactccttttagctgctgctttccatgtattttcggcagaatgaaagagcagcatatcaactcatcttgactgctgctcctttattcgattatttcgtcaggaccgtttccttcacatgcggaagaaccgtatcttcatatatttcagtcgggtatttcccagtaaagcatgccaaacactgaccgcgctgcggatcatcatacttcctgccaatcccgtccattaaaccgtctacagataaaaatgcaatggagtctgcaccgatttcctgtctaatttcttccactgaatgagaagaagcaatcagctcttcgtgtgtggatgtatcaattccataaaaacatggatgtgcgattggcggtgaactaatacgtacatggacttccgtcgcacccgcttctcttagcatcgtgacaattctgcgacttgttgtcccgcgtacgatggaatcatccaccatcacgacacgctttccttcgactacaccgcgtacagcagacagtttcatccgtacgccctgctcacgcaatgcttgagacggctggataaatgtccggccgacataacgatttttaatcaatccgagctcatacggaatacctgttgcttcggcatatccaatcgctgcagaaatactggaatctggtacacctgtcacaacatctgcttcgacatgtgcttcctcagcaagctttttgccaagattctttctcgcactatgcacattgataccgttaatattgctgtcaggtcttgagaaataaatgtattccatgctgcacatgctgcggttaatgttcatcgagaagcgctcagatttgaggccttcatcattaataatcagcatttcgccaggctccacatcacgtaaatacgtggcaccgacaacatcaaatgcacaagtttcagaagcgacaacataagcatccccaagcataccaagtgaaagcgggcgtaaaccgttcggatcaagcgccacgatcatttctgtttccgtcatgattaagaaagcataggctcccttaagcatggacagtgcatttttgatctgctcttttaattccatatgcccgctgcgcttaattaaatgagccagcacttcggtatcagaagaggtctgaaaaatactcccttggttttctagctgctgctttaactgcgttgcattcactaagtttccattatgagcaagggcaaggctgccattgttttgcgaacggaagaagaggggctgcacattttcaaagccgcctccacctgctgtcgcataccgaacgtgtccaatcgcaccttttcctttcaaatcctttagctcaccgttttgaaagacttccgtaatcagtccaaggcctttgtgtgacgtcaggttctcaccatctgttgcaatgattcccgcaccttcttgtcctcggtgctgaaggctatgcaatccgtaatatgtgatttgcggggcttcttcgtgtccccaaaccccaaagacaccacactcttcatttaagcctctgatttcagcaagcatgggatcgctcctttccatgcacgttcaagctcgttgaccgctgcatgaatccattgttgtccttcttgatttttgacagtaaacacaccatcatttgtcaccgttccgacttctttcgcatctttgacagccgcagcaaacgcttcgcggtgctccggtttcactgtgacaacaaaacgtgactgtgtttcactgaataatgaagcttcgctgtttaaatcgatttggatatctgcaccaagtccgtcagttccaaatgtactttcagcaagtgctacaccaagtccaccttcagacacatcgtgtgctgattgaacgagaccgttttgaatcgcggctagcagagcttcctgacgcgctagctctacgttcaaatcaatttctggtgcttttccgtaaatacggccttctgtcatcttttgaagctcactgcctgcaaattcttcttttgtctcaccaatgacgaaaatcacatcgccagcctgcttgaacgattgagtcgtaatatgagcagtatcttcaaccaaaccaaccatcccaataactggagttgggtaaatcgctgttccatttgattcgttatataaagagacgttcccaccgatcactggtgtgcttagcgtgcggcaagcttcgctaatcccgtcagcagacttttcaatttgccagaaaatttctggtttctctgggttaccgaagtttaggttatctgtcactgctagcggacgagcgcctgagcagacaatgttacgtgctgcttctgcgacggcgattttcccgccgacctctggatcaaggtagagatagcgcgcgttacaatctgttgtcatcgctagggcttttttcgttccgcggattcttaaaacgccagcatcagagcccggtgcaacgacggtatttgtccgaaccatgtagtcatactgatcatagacccattctttacttgcaatcgttggctgctgaaggagctgctttaatgtctgtgctgcatctgtgatcgctggagcttccacttttgtttctaaaaactcacgatagtatgcaggctcacttgacggcttatgataaaccggtgcttcttctgcaagagcgtcaacaggaagctcacacaccacttcaccttgatggagtaaacgaagcattttatcgtctgtcacatgaccgactgataccgcttcaagatcgtatttttcgaaaatatcaatgatttcttgctcacggcctttttcaatgactagaagcattctctcttgtgattcagacagcatcatttcgtatgcggacatgcctgtttcacgctgcggaatgaggtctaaattcatctcaatcccagatcctgctttactcgccatttccgcacttgagcttgttaagccagccgctcccatatcttgaattccaacgagcgcatcgtttttgatgacttcaaggcacgcttcaagcaaaagtttttccatgaatggatcaccgacttgaaccgctgaacgtttttcttctgattcatcagaaaattcttcagacgcaaatgttgcaccgtgaataccgtcacgtcccgttttagcaccaacatacatcaccgtgttgccgacaccttttgcctgcccttttttgatgtcctcatgattgattaaaccaacacacatcgcattcacgagcggattgccttcatagctttgatcaaaatgaacttctccgccgactgtaggaattccgatacagtttccatagcctgcgatccctgccactacttcttcaaacaagtacttcacgcgcggtgaagtcagttcaccaaaacgaagagagtttagtacagcaattggacgcgcacccatggagaatacatcacggataattccgccgacaccagtagctgctccttgatacggttcaatcgcagatggatggttatgtgattcgattttaaatacaaccgcttggttgtctccaatatcaacgattccagcgccttcccctggaccttgaagaacatgctctccttttgtcgggaatttgcttaaaacaggctttgagtttttataactgcaatgctctgaccacatgacagaaaaaatacccgtttctgtgtagtttggcagcctgccaataatggattcgattaaagcgaattcttcatcactcaatcccatttgctgatacaatttctcttctttaatttgcttgtgacttggttcaagcagtagtgacatgagtgtccctccaatttttcacgatagattgaaacaatttaagtccgtctgcgctgcctagtaatgaatccaccgcgcgctcagggtgcggcatcatgccgagtacattgccctcttcattcgtaatacctgcaattcgattgacactgccgttaatatcgtctccgtaagtgaaagcgatttggttattttcaataagcttcgctaaagtgtcttcatcacagtagaagtttccttcaccgtgcgctacaggaaccgaaatggattcgccttttagatagccgcttgtaaattgcgtttcgttgttctctacaatgagttcaactggacgacagataaattttaagtctttatttcgtctcatcgcacctggaagaatgccaagctcctgaagaatttggaacccgttacaaacaccaagaacaggctttccttccgcagctgcttttttcaccgccggcatgatgtttgaaaagcgagcaatcgcaccgcatcttaagtaatccccataagagaaaccgcctggtacgagtacaccgtcaaatccgtctagactcgtttcgtcgtgccatacatattcaacttgttcacctaactcatcttgaatcgcatggtacatatcgatatcacagttagagccaggcaagacgatcactgcaaacttcactgtgcgacaacctcctccacctcatagcggtaatcttcaatcaccgtgttggccagtaatttttcgcacatttctttgacgactgtgtctaaatcacgatctgatttttcaatgacaagctccatgtattttccgatacggacatcctttacttcctgataagacatgctgtgcaaggcgtgctgcacggcacttccttgtggatcaagaacactctcttttaagctgacaaaaattttcactttatacatgtttatggcctccaagtcttttgaaaatttcttcgtatgcatttgttaagccgcccaggtttcgtctgaacacgtctttatcaagcttttcgtttgtctctttgtcccaaagcctgcacgtatcaggtgaaatctcatcagctagcaaaatacgattctcgtgatctattccgaattcaagcttgaaatcaattaaattcacatggcagtctgagaagatttgctttaactcttcattgacttgtcttgtgatctgtttcatttcctcgacctgctctggtgtcgctgcatctaaaatgcgaatatgatcttctgtaatgagcggatcgccgagtgcatcatctttgtagtaaaactcgatcaatggtgtatccagttttgttccctctggaatgccaaggcgctttgacatactgcctgccaccacatttcgcacaaccacttcaagcggcacaatctgtaccttttgaatgagctgctctgtttcagaaaggcgtttcacaaagtgattgttgatccctttctcatgcagcatttgaaagattaagcttgaaatttcgttgttcagtctgcctttgccttcgatttcagctttcttttcgccgttaaatgctgtcgctgagtctttatattcaacatataaaatttgctcgtcatcggtctgatagatttttttcgctttgccttcgtagagaagttcttgtttcacagtcattcaggttggcctcctaatttgaatgttggcaattttcaggattgggcacctgacaagcaggtggcccttttcttacacaagacctagacgttcgaaaatcatatcgacatttttcaagtgatagttgtaatcgaagcagtcagcgatttgttcaggtgttaagcgtgatgtgattttttcctccgcttctactaatgaacggaatggcacttgcttctcccacgcttccattgcctttggctgaaccgtatcatatgcctcttcacgtgccatgcctgtatcgattaatgcaagaagaacacgctgtgagtaaatcaagccaagtgtgcggtccatgttgcgtttcatgttctcagggaagaccgtcaagtttttcacaatgtttgagaaacggtttagcatgtagttcagtgcaatcgttgcatctggtaaaatgatgcgctcagcagacgaatgagaaatatcacgctcatgccaaagtggtacattttcataagctgtcagcatatatccacggatgacgcgggcaattcccgtcatattttcagaaccgattgggttccgtttatgcggcattgctgatgatcccttttgtccttttgcgaagaactcttctacttcacgtgtttcactcttttgaagaccacggatttcaacagcaaatttctcaatgcttgttgcgacgagtgcaagagtagccatgtaatcggcatgacgatcacgctgcaaggtttgggtggagattggtgcagctttgatgccaagcttctcacagacatattgttcaacaaacgggtcgatgttcgcatatgtgccaacagccccagaaattttcccaaattcgataccggcttttgcttgtttaaaacgttctaggttacgcttcatttcttcgtaccaaagaccaagcttcagaccaaatgttgtcggttcagcgtgtacaccgtgtgtacgtcccatcatgacagtgtatttatgctctttcgctttttcttttaggatgtcaacaaatctctcaatgtccttgagcaagatatcgtttgcctgctttaatagatatgaaagcgccgtatccactacgtctgtagatgttagcccgtaatgaacccactttctttcttctcctagagattcagatacagcacgcgtaaaggcaaccacgtcatggcgcgtgtcttgttcaatctctaaaatacgatcaatatcaaagcttgcattcttacgcatagtcacaacgtcttcttttggaataacaccaagctctgcccaagcttcacaagcgagaatttctacttcaagccatgcattaaatttgttttcctctgtccagattgctgacatttctggtcgtgcgtaacgttcgatcatttcccgtttcctccatctctttcagtccatatctttgtgatgtttgtcatccattcatcatcaagctgtttcataaatgtcatgtgccccattttgcggccggcttttacttcatgctttccatatagataaagcttcgcttctttgagaagctcaggatgctctattgggatatctacttcatcgcctaataagttcaccatcatgccctctgacaaaaggactgtgccgccaagcggtaaaccgcatatcgcgcgaacgtgctgttcaaactggctcgtctcacataaatcgagcgtataatgaccagaattatgcgggcgaggcgccagttcattgacgagcagctctccttcgtttgtcaggaacagttctacagcaagtgtacccactagcccaagcttttcagccagtgtcgttgccagcacttttgccttctcctgaatgctttcatcaactcttgcaggcacaatgctctggaacaaaatgttgtgcttatgaatgttctcagcgactgggaataccgcaatctccccatgaatagaacgagtgacgatcaccgagagctccatttgaaatgggacccagctttctaaaatacaagttccatgtgtgagcaattcagatgcttcgtgaagctgtcctgtttccttgatcacatactgcccttttccgtcgtagccgcctctgcatgttttcaaaacggctggcaaaccaagtacagttactgcgtcttccagctcttttccatcatgaacgatgcgataaggcgcaacttcacagcctgcatctacaatcccttttttctctgtttcacgattttgcgttaaaagaagaagttcacttccttgcggtaaattggcttcttccttcaattgattgagtgcatcgtaatcaatattttcaaattcatatgtcacgacatcgctgatttctgcgagctgtctgattccatccaggtcactatatgcagctgtgatttctgtatcagcaacctgtccacagggagattgtgcgactgggtctaatacagctgcccggtaccccatttgctttgcactgacggccatatatctgccaagctgtcctccgccgataataccgatggttgcgtttggaaaaatggtctgcttagccaagctgatcactgctttctagtacagtctgttttgtttgctctcttctttcctcaaggcgagcagcgattgtttcatcaaaagctgaaatcatttgtgctgctagaaggcctgcatttgttgcaccggctttgccaatcgccactgtcgcaactggtacaccgcctggcatttgaacgatggataataaggaatccagcccatttagtgcttttgattgtacgggcacaccaatgaccggcagtgtcgtttttgctgcgaccatccccggtaaatgtgctgcgcctccagcaccggcaatgatgacttttagtcctttacctcttgcttctgccgcatattcaaacatcaagtcaggtgtccggtgtgcggatacgacctgtttttcatacggaatgtctaattcctctaagatatcgcacgcatttttcattgtttcccaatcagatgtacttcccatgatgacacctacaagcggcttcattttgtccccacctttaagctgatattcgattttgtatcgtttgacacgcttcccaaacctaagcagcttgtcaaacgccgaacaaaaaggcccgatttgcattgcattgttaggaagcaacacaaaccgggccatggtaagcgctgttcgcttttgaaacgccatgtcagttttgttcactatcctgcatagtccagtcatttacggtaactgggtagaaacttatgggccatattcccaagattatatgaggttcgtgttttgaattcatgtttatcttaacaacggatgttcatgatgtcaacggatttatcgaacaatctatgaagtcgtcgttttaatgttcggatttagactatttttccttcaaatacgatttttttcccaatcggaatgatctgaatcgacccattttccttcttttcctgaaaaatgggctcctccattcgtcggacaggcgagtagccttccgctgccatctgggacaacacttgatcgatcgtcatgttgtcttccacatagaatttcttcttctttggttttgcggtcattctttaattctccttttcttcacagccttcacccagaagccgccatgaatcgatttgggctcatatgaaatgataaatgcctttgaatccagcgttttaatcgtttcatataattgcagttcatattttctcggtgttaaaatttgcaatgctgtccggtctccttcaagaccgcctgctacccagctggtgacaccatatcctttttctctcaattgtcttgggagatcgacatctaattcttttgtgatcacgttaacagttgtgtagccaagtgccagcttctcttcaattttcatcccgacaatgatccccatcccataacctaacgcatacgcaatgacattttggatttgatctaagttatcaagtacgatacttaatccaatcacataaatcagcatttcaatcgtaccagcaaaagctgctgcgtaccgtctgcctttcattgttaaaatcaaacgcatggtggaaaaagagacatagacaatattaatcactaaaatgatcaaaaccatggtgaacgcattggataaaagttgttgaagcacgattcgaaccccctgcactaaaaaatcaaataaagcaccccatattctactagagaacataccttgatacaatcaaatttgcgcgagaaaaacacatatatctttcgacaagaacggtggtctttgttaccaagagtttacccgttttttcctcttctcaacatgaaaacctcctttttcaaaaaaggaggtttcagattgttgacaaagggctaaaatgatcttgattttagccctttgtctcctattcagcgtgatagaaaacctttgcagtctaggaaggacgagtactggcgcggagcgaatttgacattcgtgagcaccagcacgcaggactgacaccgaatgcgagggtttgtctacacgctgaacctcctttttcataaaaggaggttttcagtgtgtgtattatccaaatcgaacaggcacaagtgaaggaatcaaatactctccgacaatgccccagagcagtgcaatgatgacaagctccaccaataaaaagatccagccggcatacatcaaatcaccacgcaccgcttcatgcttcgattgaatcgagcgaaacagcacgaccgcaatcaactgaagaccaaaaaacatcatcacagataaaatgaccgtcacatatggaatattcagcatggcaaatacaagccaaaggatcgataaaaccaaaaccggtacaagtgcggcaccaaacttcatgatcacttctttcagtgatatgtttccttttaacatgtattttccgagtaaccagacggtcagcatcatcaatgtgagcagaatgagtgtaaagaccgctaccctcaaaaaggcgtcaccaaaagagtaatgaatgccaaagcctaataaacgagtctttgacgcctttaattgaacatagttgcctaaagcaaaaaacacgctgaataacacaatcgagatccaggcgtacttcatccgtaatgtttccgcttgattgatggcccgactcggtgattttaacatcgcaagtccatatgagccatagcgcttaaacgcgcctcctacaccttgcagcatgcgctgaatggtagaacgctcatcacccgctgctgtttttactttcgacgttcttccacgttttgcggcgcttctgctaagacgggattgtctcgtttcttgatctattgatggctcttcattttttacgtctgatgtactttgctcttcatctttttctaacatctcatatcaactcctatccagcacaatccttacaggctcatacgaatgacctgtaaggatgactcctcttaaagtagcggagtctctctgttcagtcaagattccttgacgttcatacgaatagacggctaaagggcatcagaggttttaaaatggcaagaaaattagggcaaaacaaaaaaacagcagcttccatgagctgctgtttcaggcgaaccattaatgatttaagaaagcaaagtagagaataaagatcacaaacaatccgtacataatcggatgtatttcttttgctttccctttaaagatcatcgtaatcgggtagaaaataaagccaaccgcaatccctgttgcaatactgtatgtgagtggcatcataatcatcgttaagaacgctggtacggcaatttcaaaacgatcccatgcaatcttcgcaagcggagcgaccatcagtgcacccacaatgattaaagcaggtgctgtcacattctttgtaacgatggataaaagcggcgaaaagaacatcgcaagcaagaagaaaatccctgtcacgacagctgcaaatccagaacgtgcaccagcagcaacacctgagctagattcaacataagatgttgtcgtcgatgttccgagaatagaacctacaacgattgaagatgaatccgctagaagtgctcttcctgcacgcggcagctcattatttttcattaaaccagcttgggttgcaacagccacaagcgttcctgctgtatcaaagaacccaacgaataagaacgttaaaatcacgacaagcatttgaatcgagaagatgtctggcaagtgaatcaaggcttgtccaaaggttggagataagcttggaatacttcccacaatttgcgtcggtactgggacaagaccaacaatcattcctgcaatagctgtcacaagcatcccaatgaagacacctgcattcactcgcagcaccattaaaatgacagtcaccacgataccaaacaccgttaataaaacaggaccactatgaatgttcccaatggaaacgagcgtattatcgttattggcaattatgccagagccttgcagaccgacaaacgtaatgaatagaccaatacccgcaccaaccgccagctttagctcagccggaatggcattgatgattttttcacggaaacctgttaaagaaagggcaacgaaaatcaaccctgaaacaaatacaccagaaagtgctgcttcccatgtgatgcccatgccaagaacaaccgagaaggcgaaaaaggcattcaagcccatacctggggcaatcgcaattggatacctggcaatcagccccatcagaatacaccctgcggcagaggctaacgccgtcgcagtaaagacagcgccctgatcaattcgtaatttatctggaaaatccggtaccgacactaaagcaagtgtgatcggattgacaaacaaaatgtaagccatcgacaaaaatgtggttaaaccaccgatgatttctctgcggtaattcgttcctaactcatcaaattgaaaaaactgtttcaagccaactgactcccttcatgtccttttgctttagtctgccccattcacaagtcaaataaaaaacgccccaacagttttgggacgcttgactacatatgtgaattcagacggtgacataaaacaagaacaatgcatgatttatatcaaacgagtgtgaattgacgtagtcaagctatttacggtagcttggtagaaacttgcgggccatatccccgctattatacgacttctatctatttgatttctgtgtctattgtaccaacttcatttttaaaacacaatacgaaaagcgaacatttttcaaagaaatgtccgcttcattcgtcttattacacgaatttggaaaatcacatctagttctttatacacccttctccaaatccttctcttttgcaaaaactgcttcggctacatggaaaaactctttcactgccggagaagcttgggagagagacggacaggcgagcgcaacctcacggtgatgagacacattcaactgacgaatatgcacaagctgctgcgtttttaaaaacagctcagggcctatcgtgacaccaagcccttccccaaccatacgagcaatggtcgtacaatcgtgtacttcaaataaagtagctggcttcaattgagcctcagaaaaaatatcctctacatgcgattgatacatgccagtcggcataataaatggttcatccgccaaatctgtgatgtctacaatggactgctggtgaaaacgatgatttggatgataggcgaccaccatctcatctttgatcagcggcagcatgtcaaagacttcatctgcatgacctttcacaacaaaaccaacatcaatgatgccagagtctagccactccaatatttcttcatacgttccctcataaaatttaaattcgattttcggatgctttttctgatagctcacaagcagcttaggcaataaacaagctgatgcactggcaaatgttccgatacgaatcaagcccgtttcgatatttttcgttaacgcaatctcctgctggatcttctccaccctatttaacacttctctaatatgcgggagaagcgtttgaccgatatctgtcagcatgatgcccttttttcgatcacgaatgaataaggacacaccccactccgtttctaaactcgccaccgcatgactcaccgcggactgcgtcatatttaatgcttcagctgctgcggtaaaactgccaagctcgaccacttttgcgataatatcaaagcgaacaaagctcatgagtattccctcatctccttcatgaaaaacatcaattttacttatgttagcacggaatttaaactaaatacaacgtatcaaattgaaggaagggttcaaaaatgaaaaacacatcctatcagctattgattattcttttagctgtcggttcattcgtcacaggcacgtcagaattcgtcgtgtcaggcattctagatatcattgctgttgatttacacatctccattcctgctgccgggcagcttattaccatttactctctcttttatgcagtaggtgctctctttttagtcatggcaacatcgaaattgaaccgaaaaaaggttctgttatcggctatttttgtgtttattttaggcaatgtagtcgccttttttagtcaacactttgtgctgctcctgctatcccgagttatcatggccatgagtggcggcttatatattgtcgtcgccacgaattatgcagcgcagatcgcccctccagaaaaaaagggaagcgcaatggcaacagtcattactggttttaccgtttcactcgtacttggtgtccctattggcacatttttatcaggtcatgtggattggcactatatttttctcatcattgcactaggtactgcttgtcttttactactgctttatcaattactgccacgcatggagggacattcacatctgccattgaagcaacaattacatctccttcaagatcgcaaagtgatcagcggattagccacgaccgtcttttggatcttaggctacacaatggtattcgcttatatctcgcctttattacgacagactgctggcttctctcttgaaatgacaagtatcgccttgctcattttaggaatcgctgcttttataggctcacgatttggcggcttcgccgttgatcaatggggaccaaaccgaaccatctcgatcagcatcatgatccagatgctcgctctctttgccatattctttacgcaattctctacaataagcatcttgattacacttgccatatggggcatcgctacatggacgacaactccggcgaagcagttttacctcatctctctaaaaccccaagcatcagaaaccgtgctgagttttaatacagcgattatgaatatcggcatgatgctcggatcgtcaatgggcggtgtgattatacaatatacaaatgtcacgaacttaagctggattggcggtttagcaagttttgtcgcattcatgttgattcggtactcgttccatcgtaataggctggcccaaaagcaggcaaaaagcgaacatgtataaccatgttcgctcttttatttattgactagcttttgatgtttcttttttgactggaatggttacaggtatatctctctgtggtgccaatcggttcagatctgacatattaagatcaagtccataatctttaaatgctaatgtgtctaacttcttatcaaattcaaaagtggattgcaaagaggctgtctttacattggtcatctttacatcgttcctctctaagtaatatctgttttcatcatttgcttcagaatctgaccatgattttagctttttaacttcacctaaccctatccattcacctacattctccataatatcttcatctaattctttctggtctactccagtaaattgataatcaactgttacagaatgccccttttgctctattttattgattttgattccaattccatgatgctttgttttgtactgaacaggcagctttgtctgaagaggaatgattttgctttcttctcgttcgaagtccacaattgtgtaaaatgttaattcagtcgcctttggatcgatcggttgattcaaaatggtcaaatgatcttttctagttttttcaggagtcagttgtttttctcctaaatctgttccaagctcaagttggtaatcattacctaaatcatctttcattctatctataatgactctatcatctttggcaaaaccattgtaatcaatggcatattgaataacagaccctttcaatcctttttctactttcacatttcttatttgataacgtccatttaaaatagacacgtctttttgtccagctaatatagtagttttttgcttcactacaggtaattcaaatcgccaattccctactatatctccaattttcaaaatgacgagtggcgctttttgaccttgcttaatcgtctgtccgtttgtatagactgtcacctgtccagcataacgaccatctttcaatttttttaattcatgattgtagtcactcgattgggtggtttcatttactggatctaggttgactacaaatggtactgaattttcttttgtattcaaatgatcgacagtaaatgtataaacaagtcgccctgtatcatagtaaacactgtttacttttacagtaattcctcttgattcagccccctcattaacatgcttcaccatatcactctgaaaaagagacattcctactttatcgtgaaacatcatataaaactgtccaataatcgggacacgtgccatcgctgtattaagagaaggaaaaaggaagcctgatgaaaaataaagaacgattagtatgatgacagagtatattggcgttctccaattccatgtgaaccaacgtcgtttcttttccgctttcacatccccaatggcttgacgaatcgcggaggtcacttcaaccattggtacatcaatctcatcatagagctttttcatttcttttcgttccatcgacactctcctccttttccaacgtttgctttaataactttcttgctcgatacaaatgagttttaatcgttccttcaggcatacccatctgctgagaaatcattgaaatcgaataatcttgaaaataaaatagctgaatcacaatctggtattgctcgtctaacacatcaagtgcatgttttaaatctagcttgtcttccagaaaatcattccgctcaacgctttcgtgctgctgatcaaacggaacaacatcttgctgctttttcttcatcgcaaaaattgtatgaatcaaaatccgagtcagccagctagaaaaataagctggttctttcaagccagatagatgcttaaacgctttaaaaaccgtctcctgaacagcatctaacgaatcctctttatttcttgtgtagagaaaagccgttttatataaacgctcctgatacatcagcattaatttctcaaatgccgggacattccctttttgtgcttttttaattagacgcacttgcttcatctcactcacacctcctacacctgttagagcaagctttctctcaaacggtttcaacaaacggacatttcttttacttagcatatgtcggataaaaatagagaaagtgaagaatggagtcgaaagagcaacttgaacttttgatataatggaagaaatatctacaaaaaggagtatgtcgattgtttcgattcgaagaacccacgtgtgctagctgtcaaaaaaagatagaaggaaacgaagaagtgtacgttaagctggtctatccaaagagaaaaggaatgacagaggtgaaggcttggctgaggaatgaaggggttttttattgtaaggcatgtacagaacaaaagacatcacatggaggataaacacatgaacaaaatgacctttccgcaatcatttccaaccatacataccgaaagactaatcttaaaacaagcaacgatcgaagacgctgaggatatgcatatctatttatccaatgaaaccgtgtgccgctacatgggcattgatgctcataaatccatcgaagacacaaaaggagaaatcaagtggtatgacaatatcttcaaagaacaaacaggcatccggtggggcatttctttaaaagaagatcctgcgatcatcggcagctgcggctttctcaatctagaaaaacagcaccaccgcaccgaaattggctatgaattacaccacgatcattggagaaaaggcatcatgaaggaagcgattgctgcggtgttacgatatggatttcaggagatgaacctgaaccggattgaagcgattattgatccagctaatacgtcctctgttcaattattggagaagattaattttgtacgcgagggtttattgagggagtatgatcttggtcaggatgggtttgatgatgtgtatatgtatgcgattttgaagaaggactacgaataaaacaaatgaaaacagatattcatttcattcaaaagccgcaatcagaatatgtttcttttcacatttatgagcttaattcgacgattgaaaagcttgtccagcaagtggagcaatcagcccccttcttcctagcgaaagatcctgagaaagaaaaaacgaaaaagatttattattacgacatcttatatatagaaagcgtcgataaaagatcgtttttgtatacgacagatggggtgtttcttataaaagaaaagttatttgaactcgaagagcaacttgaggcgcatgactatgtcaggatttcgaaatcgatgattcttaatattgattatatcacgtctatttctcctaaaacgagcggccgtttcgaagcaaacctgacaaatggagaaaaagtgatgatttcacgtttttatattcaagcattaaaagagaagcttgggttacggaggaagtgaacaggatgaaacgttatatcacaaatcttttgatcacattttgtatgatctttactgcactcgtattgatttactgtttcacgtttggaacgatgcccatctatattttacaagcaatcatgttcagttcctttttttcaagcgccctaaccttcttgctatatccaaaacaaacgtacagtcataaacggattctttttcaacaaattctatatatcgtccttgtgatgtgtatgattatgaccaccatcatcatcgtcagcgctgaaatcagtctcctttcgttcatcgtgaatttccttgtggtcatggcattattctttttgatgaagtacctattgtataaaaaagatcaagcaactgctgaggaaatcaacgaacttttaaagcagcgaaagaaacgaacaacatcttaaagtgcatcttagggctaaatattgacatgttaggaagatttaattgtgacttctgcttgattccactattctgacgttagaggaggaatcaaaacatgaaaccaatcacaatcattcgaaaatcagtacttctactgttgttttctttaatcatcccaacaagtgcaggtgtctatatatccatcaaagaagtaaccgatccaacgaacatctatctcatcaatggctgtgcgatgctggctgggtgtcttttacttctattcattattcaaaaaagtcgttttcacttgaaagaaatagggtttcgaaaagggtctcttggtatttggatatttcccatccttatcatcgaggccattccatttattgctggattaaataaggatctaaccctttcttcctttatagcactttgtttcttcatggtgtgtgtcggtctgtttgaagaaggaatctttcgaggcatcctgttccaatatttaaaacagatcaatctgagtaccgccatctggggatctgccgtcctattcggccttggtcattctgctaatctactaagcggaaaaagcctcacattaacagtggcacaaatcttattcgcctttttatttggattcgttgcagctgaaattgtggcactcactaacagcctgcaatgggtcgtcctatggcacgcggtgcataatatcgtggatcaaatgacaactggaaatacgcctgttggaatgcaaatgcttttactatccattcaatgtgtcatcttgcttgttcttgccgtgattttgtggagaaaattaagaataaaaaattgaatgtttaataatggaaggtgagtagaaaaggaggaaaggaatgaaacagcacacttggattgaagaacgaggaaaatggatcaccaaaacgaagaactgaatgatatgcaattttccaatgaaatgaaataaagagaaatgagcgagctcagtgcttcgcttttttattttctaaaaggcattccgaaaaacagaaaaattagatcaacaaacagccgatatcctcagcatcatgttatcgaacttattgattcatgtcatcctctttcagaatgctatatatttctaaatcaacaacctctttgccagaccataaaacagcttgtctaagcagcccttctttgataaaaccatttttcaaaaggactttttttgatacctcgtttgccggcttgacctccgcttgaatgatatcaatctcttcaaacataaatttcactagtttagggacccccttctgttgcaatgcccttaccccaatattcctccgccaagaaatagccaatcgtcaccgcattctttttttgattgaggtccgttgtttcgattatgccagctagcatatgaggcttgtccttaaatattttctattaaatttggtatcaaaggtttgctttctatgggtgatgataaggaaatcaatgtagtggaattcccatacttcatactctcattttcaaataattcaaggtcctttatggattcggctactactttaatcaaataattgaattctccgctaattcggtgacattctactacttgtgaagcctccttacaataatcaacgaaatgattgcatgtggtggttcggaaaaggataaaagccactatgggttttccaattttctcatttgaaatgacagcactatacccctttatcaccccttgctcttctaatcttttcactctttctgtaactgctggttgagacagccctatcaatcttccaagggaagtcattgacaacctagcatctgactgtaaacattctaatatatttctatcaatactatccatgtaataatccctccatatcattagatgatactgacatttcaccataactatttagaatgataagctctaaaaatcattatataataattcaaaaccaatatcattgaattcccttaatttcaaagttaaatacatactaataccttgattatcatatgtaaaactcaactacctgttagtataattgatttcattaactaatcaggagggcttttacaaatggataaccattttaatttaactaaaccaaatcaaaaaccttatacatcaccttcagaacgtctaccttgggctggcttaattgcacttgctatggctggattcatatgtgttcttacggaaacaatgccagcaggtctattgataccgatcagtgaaggacttggtgtgtcagaatccctagcaggtcaacttgttacggcttatgctttaggctcactcattgcagctattccacttacagcagcaacacaaagttggcgtaggaaaccattgcttcttttatgtatgactggattccttgtatttaacacgattacagccctttcttctagtctgactttaactctaatcgttcgtttctttgcgggtgtaacggcgggaatactgtggggaatgacagcgggatacgcacggttgatggcaccgaagtcattgaaaggaaaagctatggctatagctatgattggtacttcttttgcattagcttttggtctacctgttgggacatttcttggctcccttgttggttggagaactgtctttggtatcatgtcattactagctgtattatcaattttatggattttttggaaaataccagacttccctggacaaacttcagaaaagcgaacgagcctattcaaggtgtttattactcctggtgttcgtcccattctatttgttgtattggcttgggtactttcccataatatactttatacttacattgcaccatatctatccgaagcaggcctttcccagcgggttgatttggtcttactcatttttggcgttacatctttaattggaatctggatgataggtatattcattgaacgaatattacgcactttggttttaatgagtcttgctgggtttggattggcatcattagcgttaggtatcggaattagtcagcctgcaatcatttatgttgcggttgctttatggggattaacctttgggggagcagcaacactaacgcagacagcaatagcagatcatgcgaaacaaggtactgatcttgctcaatctatgctggttactgtttggaacctggctattggcggcgggagtgcaattggagccattctgatggaatcatttgacgtaagttctattccattggtcatggtattcctcattgcacttggattactagtagtgtttcgtgcaaatgtttatggatttcctttaaaaacgaaaaagagctagaatccccttatttcagtaagtggcttcaccttcatatcggttcatatacttctcttcatttacgatacgagttgagatttagatgcctacgttgctgttccgtatcgtttgacagaataactaagtgaaaaaacctgccttgaagcgcccggactcatatccgacgcttcaatttcatgtattttagatggctttcatattcacctatacgaacaacaggaaggtacaaaattttcttatttatttcttaaaatgcttttccccgttctttgatcttgcaacatagcacaaaaagtcaagtttctaaaagatgatttccgctatactaaactcgtaaagcaaggaggtgctcgattgtcctatcaagaacatgaaaaaacgattcaagaaacattgaattatattgaacaacatctaaaagacgatttaccgctacaaactctagcgaaacatgctggttattctaggtttcattttcaccgtatgttcaaaaaagtgattaagaagtcagtggttgattatatacgggaacgacggatgacccaagcggcaaaggatttaattcatacggatcaacgggcgattgacatcgcattgcagtatcgatttagttctcaggaatccttcactagagcctttaagaagatatatgacatgtcacccgcacgttatcggaaattattaaggaatgtgattaatgaggaggaaacaaatatggctgatcatcagaacacacctactggctggattatgacgggggataccccatctgaatatgaaacaggtttggataacagaattgtacacagtgggactaactccgcttatttaaaatcaaaagatgaaaaagctggaggtttcgcaacattgatgcagcaaattaagtctgatcgttatcgaggagaacggcttcaattttctgcttttgttaaaagcgaagatgtgaaaggctcagctggtttatggatgagaatcgaccattcttcaggtgaaattcttgcgtttgacaacatgatgaaccgtcccattacaggaacaaatggatggaatcattttagtgtcgtactagatgtttcagtcaaaagtgaagtcattgcatttggcatattactacaaggcccaggtcacatttggatggacgaacttagttttaaaattgtagatgaaagtgtgccagtgacagaacaaaatactgtggatcatttagaggatgaaccagtgaatttaaattttgaaggctaacagactgaagtgaagaggaggttaattgccatgaaaaaaattggtgccattttattgttcgctgtgaattcacttacctttatttgtggccttggatttttatttggtgaagaggataccacattaaaacagaagtaaaatgaagataagacacccataggacaaaaaaaatcaattaaaaaagatatccctaccactatctcttttttgtcatcttggtataatagaaaaaatcagaaaaattagaaagtgctccgatatggtgcagtgtggatctacgggatggatttcaatttcagccatttgtaatacctctccttaaatctcagccattaattatttatgattatattttattatttccgttataaatatacaacaaatactattaatttcaatatttaggttgaagtgaaagacttggtggggaactatataaaaacaagcctattttacagcttttaactcacaataaacactgtaaaataggctttttcaattcattttagtttcttactcccactcaatcgtagcaggcggcttactcgtaatatcatacaccacgcggttcacatgcttcacttcattcacgatacgagtggagatcttttcaagtacatcccaagggattcttgcccagtcactcgtcataccgtcaatagatgtaacagcacggataccgattgtgtaatcgtatgttcttgcgtcacccatgacacctacgctgcggatgtctgggagaaccgtgaagtattgccagatgtcgcgctcaaggccgaagttggcaatttcttcgcgtagaattgcatccgattcacggacgatttctagtttttcttcagaaatttcacctagtacacggatacctagtcctggacctgggaatggctgtctccagacgatgtcgtcaggaatgcccagctctgaacctagggcacggacttcatccttgaatagcgtgttcaaaggctcaatcaattcgaactgcatgtcttctggaagaccacctacgttgtggtgagatttgattgtttgtgccgttgctgttccgctctcaatgatatctgtgtaaagtgttccttgtgctaaatagtcgattccttttagcttgtccgattcatcatcgaatacatagatgaattcgttaccgatgattttacgtttttgctcaggatcagacacaccttttagcttgtttaagaaacgatcttttgcatctactttaatcacgttcatgttgaaaccttcgctaaatgtcttcataaccccttctgcttcgcctttgcgaagaagaccgtggtcaacgaaaatacatgtcagctgatcgccgatggctttgtgaatcaatactgccacaacagatgaatctacaccaccgcttagtgcgcacaatacttgtttgtcgcctactgtttcacggattttctgcatttcgatttcaatgaagttctccattgaccatttgccatcgcagtcacacacgccgaagacaaagtttttcaataggtcatttccgtattcagagtgacgaacctctgggtggaactgaacgccatagaaattcttctcagctaaactcatcgctgagtttggacaatgtgcacttgttgcatcaactgtaaagccttctggtacttcaacaacgaggtcaccatggctcatccaaacgacttgatcagtcggaaggtctttaaataaagcaggcgttccattaatgtggatatctgcttttccgtattcacgctggcttgccgcttctactttcccgcctaaatagtgagtcataagctgcatgccgtagcaaatgcctagaaccggaatgtctagatcaaaaatcttttcatcacagcggaaagatccttcatcataaacactgtttggtccgccagaaaggatgattcctttaggcgccatttctttaatttcttcagcagttaaagtgtgcggatgaagctcactgtacacaccaaattcacgaatacggcgtgtgatcagctgattgtactgactgccgaaatctagaaccaaaatcatttcatttactaaatttgtcatggtgtcacctctatgtccaatatagttttttataaacgcacagaaaaaatgagaggagaaaacctgctctcagtgtgaatcacgcttttgaagcgcccagactaacatccgaacgcttcaatttcatgtattttagaaggttttaatattcacctattctaacaacaggaaggtacggggtcaagactatctcctgtttattaaattttcccataactttgcggattgcccccaaagcactgacgcatcctctcgtcgatagagtgcccgctcatagagctgcgtcagctctgacatccgatgatctccatccttgtcatcgatcaaagaagcgaattctcttagcgtcatgccaggttttttctcaattcccctgcgcttcagctgctttaatagcgcagcatacgcatagaagaatgcttcctcctctggcagacgtttcacctttctcacaataaagaatggcagccatcttgctctgaatcgataaagcatccagctgatcaatcctagaaggatcatagctcctgccgcaaaacccaggattgaaccaacatgtaccatattacgcttcgcttgcgctgtttgtttctttggttcagccggctgcgctgtctcctgctgctgcggctgttcggcctgctgatcttcgcttgcatcggagctagactgatctttttccttttgatcatcatctgcttgatcacttgaagccgattcatttgtaaaggtctctgggttcgtaaaaccttttgtcggttcgaaggtcacccagcctctatttggaaaatacacctctacccatgaatgcgcattgttattggtcacttcatacacattgtttccatccatctgtgtttcatataattgacctgacgtgtaccctttcacccatctcgccggaatcccaatcgaacgaagcatcacaatcatagaggttgaaaagttatcacagtagccgatcatcgtatcaaacaaaaattgatccacataatcttcttgacgactaggcacagcgacattttgcgtttcatatgaaaacttcgcagaccctaagtaatcctcaatcgctttagccttatcgtacatattatccttcgtttccgttaagctgtttgccaatgttttcactcgctctggcaatgaggaaggaagctgtaagtattcacggccaacctcctgattgacctgcttctttgtcggtactttgattctctgcaaatcctcaaggataaatgtaggagacaaaaaggtgacttggtagttccctaaatttttcggcggattttgaatggatgggacgattttctccgttttccccatcatttgcagcggaatgttttccattggcatcagcatgatcgtcccaatcggatagacggcatgattaaatcgataattcgattccatgtcaactctcgtttcgtgctcgtctgtttttacacgctcggtaaaccagcgattcggcacactgtcctcttttagccgcgtaggtttcgtatcatttgaggcatcctcccagccctttccggtgtagatgctttttgtttcgacacgaaagtaggagggttccttaccgctccatttaaagaccggtgtgcggtcctcactaaatggtccgccaagcgatgaatcatctgtactatatcccaccttattctgtccggcagagccatcttgattcgtcaccgccttaaaaaatgggacaggatcaggccatttcggatcagactttggtaaagaagcgccgagtgtcgctgacagaagaacaagcgccagcatgggcaaaaaccactttagacgcgccttctgtgatacccgaatgccttcagtcgaacgcagtcgatcgaaatacagcaacccaagcaaacaaaaaccaaacaccataatacgaacgatcgcaaaggttgcatcatatggcgtaaacgtatccagaatcgtgacatacacaatcgtcataagtaaaaagaaaaagatacgctgctgatagaccacccaataatgaagcaagtagacaagcagccatagcaaaatataaaacaataatgtgcggaaggagggatacatgtcactccacatacctgtgctcatcaaggtgatattatctttgatatcagcaaataatggagccggatagcttggctctgcttgataaaagatcaaatataaggcgagcaaaatcaagccagtacaaataggaaacgtcacataccacttcaaacgaaagaatgtaaacaaacatgtaagccctataaaaatgatgaaataagacgtatgactcgtctctgtaaaatcttgaagcggtcgaagccattcccaaagcagcaggaatgctacagcataatagatgaacaactcaaaacggctttgccgctgatgcgtatgcagcataaatgtttgtcacctcacagttctttcgtgcagccggtcttcaaataaaacggtcgtgcgtattccagatgccttgagccggtctacaagctgtttttcttttgtcgtgaatcgatccacggctctcttcactaaaagaacagtgatgttctttctgtttcgatttccaaagaggctcgcagcaagctcttcatgcagatgacccgtaatgacatattttccagagtattggtactcactcgctgcgaacgctttatattcgagtacgcgagaaggatgatgctgcacccttgttaaaaagtaaagcatgtcctgcaaatgagattccccttgatccactcgaaagacacgctgatcaccaagtgggacaaggcctgccggaaccccttttttcactgccgattggaggacagacgctgcaatagacacgacggtctcaaaaaccgcttcatcggtaaaatcagcaaacacgacaagatcctttgtttgattctgttcaaactccttcgtcatgagctgacctcttctagctgtcgtcttccagtccacccaggcaaaacggtcgccttgctgatattcccttacacctgttgtcacatgggtcggttcatttaaccacgagcgaaccgctttgcctccattttcattcaatgactcagcagactccacctgaagatcgagcattttcggataaacaagcagctttttttctaacgggatgatgacttctttctccacaaaaccaaacatatcacccgttttgattcgaactgctgacaaatgatgttccccgcgcatgacatcattcaattgataggaaaaacgccacgttttccgaaaccaaggaaacagtatttgcttcatttcaatttgttcctgtaaatgaaaggtgtctggcggatcctcctcaatcaagacgtaaacgtatggaaatagatttgtccgcttgatttcaaggtcaacaggcagcacgtctcccgccttcaagtgagtttgttgtaatgtccttttcgcagtcactctcagcggaacaagcgcaaacagcaaagcatacaatgcatatggtaaaaatgcataaaaaaggaaccaactcacaaaccctccttgaaacatggcataacaaaagactgcggcagtgagaatgatgagcatcatcacccgtaaccataatgaaaaagcgaaacgatgacctaatttcattgactcatcgacttttgaactggcacgccaatttgctcaagcatttgtcgcagcagtgtctccgccttcttcccttcatacgtcgcttctgatgtcaaaatcattcgatgcggtaatgtataagacgccaaatactgtacatcatcaggaatcacataatctcgcctgttcaacagcgcatacgcctgagccgctttcataagggcgatcgatccccttggactcacacctagataaacagatggatgctgacgtgtcgcctgtgcaatttccacaatatattctttaatggatgcatccacatgaatggtctgaaccgcttgctgcagcgcatggatatgatcatttgtcatcactgcttggagcgtatcaatcggggactgcttttcctgcaagttgagtacctccagctcttccagcatggtcggataccccatttgtagcttgaataaaaaacggtccatttgcgcttctggcagtggataagtcccttcatattcgactggattctgcgtagccatgacgaaaaaaggatcagcaagtagcattgtttctccgtccactgtgacactgccttcctccatcgcttcgagcaatgcagactgtgtttttggagaggtccggttgatctcatcagccaaaataatctgtcccataatgggtccttgcctaaattcaaattcatttgtctttttattataaatcgacacacctgttacatcagatggcaaaaggtcaggagtgaattgaattcgcttaaactcacagccaatcgattttgccaaagcacgaaccatcatcgtctttccaacaccaggcacatcctctagcagcacatgccccttcgccaaaatcgcaacaaggcttaatatcgcaatgtctttcttcccaaccatgactttattgatgttatctacgattttttttaaatctgaatgcattggttcatcaaatgccatcctgatcctcctatcacgtttccgttaaatttcatatagtctaactttaccatacaacgcgcaattgcatataacatcaacacgtagaaaaaaagaagccttctcacgatggaaaagacttcttctcttcttttggctcacctgctggctccatatgaacatgagagtgaagaatatcatgttccttcttcattctacgttcgatctcatctgcaatatcatggctttctgcaatgttcaagtgcggctcgacctctactactacatccacatggaccgtgcttccgagataccgtgccttaatatctttcaaatcgcccaccccaggtgttgcttcaatggtctctttatatttggacatgtcttttatatgaaaaccgtccgttaacgaatgagaagcatctctgaaaatctcccacgccgttttacaaataatgaggccaatcacaaacgctgcaagcgtatcaatccatgccaattgaaattgagaggcgataatccctacaaatgttccgatactcacatacgcatctgatttattatcagctgctgctgcatgaagagcctggctattgatccgtttggacagattgcggttgtaaatatacacaccatacatcaccacagcacttcctgctgccgtccaagctgcgatcatatcgggtgtttgatgctcagacgagaagagcgactggcctgcactcagcagaacctgaagtccaacaagcatcataataaaggacgccacaagagacgcaatattctctgctctaaaatgaccgtatggatgatcttcatcaggcggtttttgagaaatacgaagtccaatcaatactgcaagggatgcaataatatccgtcgtattattcaatccatctgccgaaagggcttctgaatgaaacgtatacccaatcagaagtttcaccgcagataagatcacgtaggcaatgatgctgacccaagcacctgtttcaccttgtcttaattcgttatagcgctccatgtcgaaccgcgcctcctcacacatcacttttctattatttatcttacaaagcaaagcccgtgtgggtctacagcaacatgattcgcttgtgtcagcaaaataggatacatagaaatgtgttgacctaagtaaacttatttttataaggtcaattgacctcaagacctactcccatcaacctttttccaattcactctgcgaggatcatatgggcaatatcactcttactagtaaattgtcagaaaaattttattttaagacacaacttctcttcatccgatcttatgctatttttaagaatgaacagaggaaaaagagggaacataatctctcaaatcctttatactttttaacatcatgttaagaggtttgaaatgtcagtttgataacctgtccaatgctgaatgacaattcagtgtgataaaatttaaaatattctaaaaacaaattctctatcaggagaaatgtttggaggtaaagacatgtccaacatgacaaacggtcttcaaaaaaatcttaaaacaagacatatttcaatgatctccattgctggggttattggcgcagggctatttgttggtagcggcgctgtcattcattctgcagggcctggatccattctttcctattcttttgccggacttctcgtgatctttattatgagaatgcttggagaaatggcatgcgcctatccgacaagcggttccttctcacaatatgcgagcgacgccatcggtccatgggccggttttacaattggctggctttattggttcttctgggtgattgtcatcgccatcgaagccattgccggtgctgccattattcagtattggtatggagatgcacctgtttggctcacaagtcttatcctcactatcctcttaacattaacaaatatcttttctgttaaatcttttggcgaatttgaatattggttctcattaataaaagtcgtcagcattattctctttctactcatcggttttgcatttatctttggttttggtggtcatcatacagtaggtcttgccaatttaacggggaacggcggtttccttccaaatggattcagctctgttttactcggaattgtcgtcgtcatcttttccttcatgggaacagagattgtggcaatagcggccggagaatcagcagacccggtcaagtctgtgacaacagctacccgctctgttgtatggcgtatcatcgtgttctatgtcggatccatcgctgtcgttgtgaccttgcttccatggaattcagcaagtattttaacaagtccgttcgttgcggtattagaatacatcggcgtcccatcagcagctcaagtcatgaacgtcattgttttgacagccgttctatcttgcttaaactccggattgtacacaacgtccagaatgctttattcattggcagaaagaggcgaagcaccgaaacgctttatgaaaatcagcaaacgtggcgttcctgtagcggctacagtcgctggcaccttcttttcttacattgccgtcatgatgaactacttttatcctgaaaccatctttttgttcttagtcaatgcatccggcgcgattgcccttcttgtctacttggtcattgctgtttcacaattaagaatgcgccgtaaaatcgaaaaagaaaatccagaacagctcaaaatcaaaatgtggctctttccatatctcacgtactttaccattttggtcatttgcgccatcttggcatcaatgctgtttatcgaatcaatgagaccacagctcattttgacgagtatcattaccttcggtgtgcttgccgcttatttcatctttaaaccgaataaaaaagtgcctgcaaatgcatcgcttgaaaataaacatccgtaatgctcccgctgaaaagcgggttttttattttattcacctattttgatgtccgcacttatactgtatcaaattggattttaagtgaggattagacaacatgaacctagaaaaatttgttgacgagctgccaattccagaagttgcggagcccgtcaaaaagaacccaaggcaaacgtattatgaaatcactatggaggaggtatttctaaaagttcatagagacctgcccccaaccaagctatggacctataatggcagtttgcctggtccaaccattcatgcgaatcgaaatgaaaaggtcaaagtgaaatggatgaacaaattgccacttaaacattttctaccggtcgatcacaccattcacgaaggccatcatgatgaaccagaagtcaaaaccgtcgttcatttacatggcggcgtcacaccagcaagcagtgacggctatccagaggcttggttttcacgagactttgaagcaaccggccccttctttgaacgagaagtgtacgaatacccaaatcatcagcaagcctgcacattgtggtatcacgatcatgcgatggcattgacacgactaaatgtgtacgccggtttagctgggttttatttgatctcagatgcatttgaaaaatcgctagaattaccgaagggtgagtatgatattccgctcatgatcatggaccgtacgtttcaggaggatggcgcgctgttttatccaagcagaccaaacaacacgccagaagacagtgatataccagatccgtctatcgtgcccttcttttgcggagaaaccattttggtcaatggaaaagtatggccgtatttagaagtagaaccacgaaaataccgttttcgtattttaaatgcatccaatacaagaacttacgagctgcatctagacaacgatgcgacgattttgcaaattggatctgatggtggctttttaccaagacctgttcaccatcaatcctttagcattgctcctgctgagcgatttgatgtcatcatcgatttttcagcttacgaaaacaaaacgattatccttaaaaataaagccggctgcggacaggaagtgaatcctgaaacagatgccaacatcatgcaatttaaagtcacacgtccgttaaaaggaagagcgcctaaaacattacgacctattttcaaaccgcttccaccgcttcggcctagtcgagctgataaagagcgcacgctcactcttacgggtacacaggataaatacggccgccccattttattgctggataaccatttttggaatgaccccgtcacggaaaatcctcggctgggcagtgtagaggtttggtccatcgtcaatccaacaaggggtacacatcccattcatttacaccttgttcaatttagggtgatagacagaagaccatttgatacagaggtctatcaatcgacaggggacattgtgtatacaggaccgaacgaagcccctcctttacatgaacaaggctacaaggacaccattcaagcacatgccggtgaagtcattcgaatcatcgctcgctttgttccatacagcggcaggtatgtgtggcattgtcatatattagagcacgaagattatgacatgatgcgaccgatggatattatttagtaacttgaaaccaacccccatcacatacgtaaaaacatgtattgagtaaatcattacgaagggctaacagacagcggtatattagccctttccttccttttcattgaagcattctaaaataaaacaaagcatgacttgaaatggcatttatttgtacattcaacacttaaaaagttgacgcagcaaaccgataatactactatatacccattgcatctatcaaaaggcacatttgccacaatgaacgaacaaatggaaaattgcgataaaaaacggaggagttcaatttgaatgaagaaaaagagacttgccagatcacacaagaaacagcggcaggtaacatagagaagctttcaattcagaaaaacgagagcattcggtcaaatattgaacagctaacaattgaactcggtgaacaaaaagaattcaaccacttcatattagatgaaaaacaaaaggccatcagcacattatctgccctcattacaaaaggcgattgtgatgaagaattaaagactcattttgaacaagcattacatatcggactttctgtcatagagatcatggagattattaagcactgtacaaaagttgctggattccctcactccattaatgccctgtttatctttcaaaacttattagacaataacaccaaataaatcagtgaaaacgagaagccatctgtcctctcgttttttatgtccattcatattactctctttcttttcctctgtcacataagcaaaatatgaaaataccacacatttcccaccttaaaaactgattttccttacataaattcctcaatttctgcaacatgtcaaacgacaaaataaaaaaacgttcagttatataaaaataactgaacataccttttatcgattgacagtgaaattgttaacaatcccgccatccttctcccacgcggcttccactgtttttttcttgatatcgtattcaaaaatcgttcttacctttgcttttcgtccggtgtcatcctttaattcctttgcgtttttagcaacacctaagaaataaacagaagacccgtccgtagaaaattgcggctgtgcggcacttagaatatgcacacccttactgttcttaacaagtgttgcctgttttcctgtttctacatctagcattttaatagaggatacttctttttcatttcgcatcttcacttctgtataaatcaatgtcttatgatctggtgaaaatgaaatatcattaatcgtttgcgagatgcgtgcaattcgcttccccttcgcgcctgtttgaagggtgatcttcatagtcgttggttcagggtctcttcccttttcattcgcttcgtcggttttcttgtaatcttcttttaaggaataatgctggattgccagaaggtttgacgccggatcatatgcaaaagaacttaccgtgtcatccttgcttttttctggatacaatacatccactttacgtgtgttgacatcaaacatagcgacataaaattgttccccagaatccttattatacctaagatataactgtttcccgtctccagacagcctcatactgtcgatggaatcatcactcgtaaatagcgttttttcttcatccgtttttacattcagttctcgaatactcactttttgcgtgtcttcatccgtatacgtgtaatataaaagctgtttcgtagaatcataagcaatcgaaggatatgctgtcagtttctccgtatgaagcgcccggtcatgcagataatacgtattgtttaactgttgatctgtaaatgaaacgagtaattcgtcttttgcattctgatttgttttcacttttcccgcatgcttcgtctcttgatccggcttcatcataaagaaaatgacgaccgcaatcactgcgactccgatgaccgtgatgatccaccatgttgattttttcattgcctttcagaccctctctacaagaaaagaagccagaaaatgaacttttcccgcttctttgcatgcctatgtattaataagtgtaatgtccttttacgacacctttacttgttttatacccaagtgctttgaatgcttttggactaacgtctaatacagcgtttggcattctacctacatcatatttatatactgtaatcactttatgtggtttcgcttttgttgtcactcttaattttgtaccttttttcggtacgtcaaatcccattttagttgctgcatcccaatgaccgagtttttttccatctgcgccttttttaccgacaccattataccaagtaatattgccgcttactttttttgcacttgctccatgtgagaaactaaacgccaaaaataaactagctactgttacgattgtcgcgataagctttttattcattaaaaaatcctccgtatttggtttctgaactcattatacatgaagatgcacccctttattttacagacacgttacaattcgaatacaagttgaccacttttcgaccggtttttttcataattaataccaaaaccatccataaaattgtaagtagatccccccttttgattttatataataaaaatgaacccattataaggaggagttttcatgaaaaagtggtttatcgttttgagtgtaagtttgacctttgttttgatgctatcaactatcccagcatctgcagctagccctcgtcacggcgcgattgtgacacaaacggatgaggccaaatggtcgggtatctcagctgatattgtgctaccgaaaacagctaccattaaaaatggctatgcggactggtatctcggtctcggctctgccgttgttgagagcggtatttcaaaaacgtcttctggctacaaggtctttctgggcagcggctcacaaggcggcagcaaatactggaacagtgaatacgataagagcattaaggatggcgcacgtgttaacttaaagctcatcaataatggtgatggcacagtgtcactatacgtcaatgggacattgcgctataaacagcctgtttacaaccctagccgtctgaaaaacctcgatgtcgtcaagatggtacacggtgtacaagataatggaacaaacagctactcacaagcaagcttctcaaatgtacagcttcgtgcaaatacttcaggaagcgtctataaaaaatgggatggatccatcaaatcatcgcttttacgtaaaaatttagagtctggtgctgcggctcccaaattcaccgtcatttcttctgttccattaagtacaagcctttcagcacaataagaaaaaaaagcgccctttttgggtgcttcagattgttgacaaagggctaaaatgaactttattttagccctttgttttcttttcagcgtgatagaaaacctttgaagtctaggaaggacgagcatcggagcggagcgaatttgacattcgtgagcaccgaagcgcagacctgacaacgaatgcgaaggtttgtctacacgctgaagcgccctttttgggtgttttttattgttcacagcatatcaacacttctcttttaatcaaatcaaggattcgtggtaacataaacatacatacttcgaagaaaaaaggagaacgaacgtgaaaaaaagtctacttgttttcatgagcctagttgcaggtctcttcatgctagcagcttgctcaaatacggcaaacgaacaaaaaacagaaacgaaggcacttccaacgattaatgaacgcattcaaaaagaaacgaaagaagtcatggagcagtctaaacttataaaagacacggatatcactgttgatcaacaaaaaaaagtcatttctttacatgtaacagcttcttctgataccaatagtgattacgctgaagtcatcggtttaaactttgccaagacgctggccattggggcatcaactgaaaaagaaaacaacctgcacaaacccgaaaatgacagccttggcgccctctattccttttacgacctaaacatcaccgtgaaacaagaaaacggtaaagtgctggcaaagggaacgaaaaaaacaaatgaaacaaagatcacttgggaaagagcgcagtaatttagaaaagcttgtagaggatcgctctacaagcttttttcaagtttatataaacaaatcgtctctcatcgcatcgaccagtgtgtgaatatctgagtgagcccatgatgctaatcgtaccaacaaatcatctatacactcatacaaatgacgttccctcaaaatatactccttataaaatggaatgacaaagaaatagagcaaatcagccaattcaagcgcaacgatatcgttatcctcaacttctaatgcctgtccaacacgttgaatcagccaatgcaaatctgctttcttttcaatcggaacatacatcagttgatgaatgttatccgtatccttcatttgtaaaatccgctcagccgcttcctttgacagcgccccaatttctgtagaagatatattaacaaccgctaattcatcctctgatctcacttgattcatttgcagcaagttttggtccatcttgactcactccccatttctcagatacttttattataaggaatcgatctgattttttatggaaatagtggatttttttatgtaattttaaagaaaatgtgacattataagccaaggtatcttatatctctcaaataaaaaagcactcttgatcataagagtgcttttctcatacatcttttactccctttttcattgcctcagccatttccacgtcaccctctgcttccaacttttcaatgatgtgagcataatccctttcattgcgattttggcttattttaaaagcatcctgaacttcatcaatgatgattttaaagcctacaatgcctttcatttgtttctctaacaattcatcagataacgtatgccataacactggttgttctctatgtctttcgtatgtctccagcatcgttgttaattccttaaccagttccgatttttcaaacagtaccgcctttccataaacatgaacagcctggtaattccatgtcggtactgattctttttcataccatgaagaggatatgtaggcatgcggcccttgaaagatgacgagcatcttttcattttcttcaaacattttacactgaggattcccaatcgccatatgccctgaaatcacatacgaatcgtcaacttgatgaaaactcaccggaatatgtgtcgcaatgggcttttcattcattgtcgtcacaactgtagcaaatgaatgagattgtataaatgatttgattttctctaaatccttcacttgaaaaaatgatggaacatgcatgttctcttcccccttttaatcagttcaatgttttggtcataatgaaatccatttgctcttcgtcccccatgtgaaaggcgtgcaccccttgcacccctgtttgaacaaacccaagtttttgatagaaagcgatggccgctctattatgctcccacacccaagccaaacatttcgtttaagatgatttttcgcaatttcaatagcttgatcaattaaatatcggcctaatccttgcttttgaaaggattgcctgatataaattctttcaatctctaacgcgtcactacccatctcttctgattgggcatcatccatattgaccttcaaataaccagcagtttccccattcacttgaacaaaataaaactgtgaagaagggttctgtaattcctttaacaactggtttaggtgaaaagctgtcttcacgtaagcatcgagatgttcggctttgttttgattcgcaataaattcatgcagttctagctttttgatagcacgagccgcctttgttcgatccatcttaatcatttccgccaacttttcctgaatgatacctagctcctcacaaatacgcacaagatataaatacttatcgtactctttaaattcaatattactaatgcaatcaatcaagcacgcgaacaagcacgccgatctaccgcaaaatttctttcatgtatctcgacttcatttttgttgtaatttcaataaaaaaaccactttaataagaagtggttttcaactctttctttatttatcatttatattttatctaaacatgctgattagtacgaaccttgaagaacctgaatcataccatcagtaaccagcacatattcaattaggatacgagtgatgacaaaagcagttcatttcttacttgaacggacacttttcttcaacaactgtatatctttagagaaatttttaggttgtatgctgctcaacacctttttctcaacctcaggagtccaatagattttcaatttatttcttgctcgtgtaatagcagtgtacaatatattatgtgttattagttcatcgacttcgtctgtgatgacaattttaacagagttgtactccaaaccttgtgccttatggatggataatgcataagcaacttggaatggtataatcgatattgaagagccttcatcatcttcatcagtacttttaagtttgttaacacaaaaacgtataactgaattcccactttctgtgctgtcgatcaattcaaggtctaggtcaaaggtatgcagactatttattacaatatctagttctatatcaaattggatacgttcactgggcttatcattatcaagaatccttattccaactattctccctttcatattattataaatcaagggagtaaagcgatcagattcattaaataaaatcggatcacctattttgtactgctgaattccccagaaaactggatcatttttattactattttgtaagaagcgattgatattatttattccatataacccgtcataattaagacaaagaataatttcgtctgctttcgcaggatcaaaaatagaaacgtctaactctttagaatagcctctttttgcaatagtttctaaaatagtattgtccattttacgtactttatcccaaagtgtaagcagtcccttgtcactactacgataaggttttgttaattcaaaaatagaactattgggaacaaactctttagcaacactaaaccaattcccaaacctaatagaagatatctgatatgaatcgccaaccataagcaaaagcttgtggttagctttgttaagaatatctctcatatcttgattgtttaccgtactacattcatctatcactatcagatcgtagtctgtatcaacacacttcctttttaggaactttgtaattgttaaaaaatcacaattcgcggctgtcactcttctttttaaattatccacagcagggttagtctgtgctaaaaacaacttcttcttattaacaaaaaaatgtgatatatgatttataagtgtagatttcccagttccggcagaaccgtacatcaaagcaactcgtgatttttcaaacatttgagttaaaataacttttttctcatcgcagtcaacaccatgatttggctcatctaaccatgctttcaccgaattggcatagttctcaattccattttttgaaaattcctctagttgcgcaataattaaaagggtgtctttcttatatccattaataaaaagctgccctgaatcaactactaatttgcttcgttgataatgtttttcatgcaaatttgaattgtaaattttaataagttcatctatttcatcaaatccaactatatcttttatcggtgtgaagagttggcccttgatttctgtattattcctaactagacgagcaagtatttcatgttttctttctctagcatcaatacaagcaaacaaatcactcaacttaggattatgccccaaaggagatgaattaaagggaatcttatcaaaaggaatacttccgtattgcataaaaacccttgacaacttagggtttccactgtcaccttgctgttttttaataactttattgttcatatgataaagtaaataacgaaggatattactacccggagcgtttgtttttattattttacgacaatgttctaaatcatcaaagaaaacagccttcttaagtcgttgagtaacttgttgttttatatttagaaattccgaatcgctgaagtccactagttgtgttaaattaaacccagatgtcaaaaactttgaaataccctgctgttccgcatatcctgtcgaaactgaaaagcctctgataagtcttgtgaaatttttatattcgcaatcacgaatggagacttcccaatctactataatcataataggcatagttttacctagaatctctatattatcttgagctaaggttaacttggcagcatagttatctgttatatccaactttgtaaatgcaataactctatcaaatttgctagcataatcattagcaggcgtaaaagtcacctcataataaacctgttgattgataaagaatggtttaatcttttgaatatagtatctttctgatttattcccatcccgcataccaaagtgttctactttttctgcaatcttctcatagtattcccttaaatttgaatctgtgttaagtggaaacttatcaaggttttcaaggatatttaatgaatacttatcattcatgagatttttaatttttaaaagatattcataatatttaagcattaaacgctctgaattttcttcatccaatgtatagtgtgatgctacgatttgcaagtattcatgaaattgtctaaggacttttaaatttccctgcgacttaacaaattcaattgctttagtgatattagcatattcattttctatatcttgaccgtttgcatagaacttcaacattaaatgctcaacaaagttacgtagttgtgaaagaatgtcttgtgaaactgctcctcttgaagaaaaatcactgttgtctaagtgacggcaaataactctatttatattaagaatctgtgtgtctaatgtatatgatgttacattggtcatactgcacctccattaaatttactacccagcttttaaaagaaaaaagaatctaatatcttctaatctattagttacattttaataaatttaattcgacaaaatttgttaaaaccctctaatattagactcattgatatataatattcaaaagttcagcagtatgaattattttagaatacatgacgtcataatataagcagacattacaaaataatttcctttcatggtaaatattttattgtaattaataaccttattatttacaataaaggagataatttatatgaaaggatattaaaatgtcattagaacaaacaaccaattcaagtgaaaatcaagaaaaattaacaacaacatgcgatacatcaattttatatcctagctctgaaattttactttcaacgataactagagaatacgatgctgaagctaatagaaaaagagatatcgaaacaagagccggagttttccttgcacttttaggagctttaataggcttttatgcaacagcgttggacttttcatttttcaaaaaagcgaacagtccaattgaaatgttatgttttgtaataatcgccatgctatatattttccctgctattatgcaattgattgcgtttaagcacttaattaatgtattaaaaacgtatcaatacgagtctcttggactaggtgggtttaacccagaaaatatagaaatgagcgccaaacttcgtaaagatgaacttcaatttcttttatcatcttcataccatgctgttgttgagaaaaacagtattgctaatgacactaaagctaaactttttagaaatggtacagaaaagatatacatttcaataattggtattgtttttgtatatttcttcaaacaaatcattcttttgttgaattaagaaaggagcaaaagagatgtcagacaaggacagttggtggaaagatacagccgttaataaaaaagaagatactgataaaaaacaagataaagaaaacatttttttaacttcaagaaaagtactgaattacggcgtaccacctaaaaataaagacttcgatccaagacaagtagagtacgacgtatttccaattgatattgtgaagaatttaaaaaaagacaataaataaacctctctaaattcggagaggcttatttattattttaatagtgattgaagatataaaaaatgcaaataaagcatgagtggatgtcacaatattgtatttgctggaataaagggtccatactggagatattaaaactattgagaataggtttaatgcagttctaaaaaaatcagggatacagaagaaattaactcctcattctttaagacatactcacacctctcttcttgctgaggctggcgtggatcttcaaaggataatggatagacttggacatacagatgatcaaacaacaaccaaaatacaccttcacataacaaaagaccgaaaaaaagaagcttctcaaaagttcggagaactaatgaaaagcctctaatttatctatgtggcatcaaaatggcaccaaaatgagtgtgacttacggataaacccttattaatcaagggtttaaatccgtaattacatcatgccacccataccgcccatgccgcccatatctggcattccgccgcctgagccgccttcttctggtttgtcagcaacgactgcttcagttgttagaagcattgctgcaacagaagctgcgttttgaagtgcagagcgagttacttttgttgggtcaacgattcctttttcgatcatgtttacccattcgtttgttgctgcgttgaagcctacgccaatttcttcgtttttcaagcgctcaacgatgactgatccttcaagacctgcgttgtgagcgatttgacggattggctcttcaagagaacgtagaacgatgtttacacctgtttgaacgtcaccatctgcttcgattgaagcgacttttttgtatacattcacaagtgctgtaccaccaccggatacgataccttcttcaactgctgcacgagttgagttcaaggcatcctcgatacgtagtttacgctcttttagttctgtttcagttgcagcaccaactttgatgacagcgacaccaccagctagttttgcaagacgttcttgtaatttttctttatcgaattcagaagttgtttcttcaacttgcgcacggatttggttgacgcgtgctgcgatttgagcagaatctcctgagccttctacgatcgttgtgttttctttagtcacaacgactttagacgcgcggccaagctgaccgatttcagttgattttaggtcaagtcctaggtcttctgtgattaactctccgccagttaaaacagagatgtcttcaagcattgctttacgacgatcaccgaatccaggtgcttttactgccactgcgttgaatgttccacgaagtttgttcacaacaagtgttgcaagtgcttcgccttctacatcttcagcaatgatcaacaatggttttccttgttgtacaacttgctcaagtacaggaaggatttcttgaatgtttgtgatctttttatccgtgattaagatgtaaggattttcaagaactgcttccatcttatcagaatccgtcaccatgtatggtgaagcatatccgcggtcaaactgcattccttcaaccacttcaagctcagttgtgaaccctttagattcttcgattgtgatcacgccgtcgttacctacacgctccattgcttcagcgattaggcttccaacttcttcatctgctgcagaaatagacgcaacttgagcaattgattctttgccttcgattggtttagaaatctcgtgcaagccttcaagtgctactttcactgcttcttcgatccctttacgaacgccaacagggtttgcaccagctgttacgtttttaagaccttcacggatcatcgcttgagctagaactgttgcagtcgttgtaccgtcaccagctacgtcgtttgttttgcttgcaacttcagccacaagttttgcacccatgttttcaaatgcatcttctaattcgatttcttttgcaatcgttacaccatcatttgtgataagtggagaaccgaattttttctcaagaaccacgttacgtcctttaggtcctaaagttacttttacagcatctgcaagtgcatctacaccacgtaacatcgcgcgacgtgcttcttcactgaacttaatatcttttgccataataacgaaacctcctcagtctttttaaaaatgtatctcaatgttttttatgtgattaaccaataacagctaaaatgtcgctctcacgaaggattaaatattctttgccttcatatttcacttcagtgcctgcatattttgagaagataatgcggtcgcctgtgtttacttctaacgcaacgcgctcaccactttcaagtacacggcctgaacctgctgcaacaattttaccttcttgcggtttttcttttgcagaatccggtaacacaataccgctagcggttttttcctcagattcaacgagttcaatgattacgcgatcgcctaatggctttaacataagaaacaacctcctcaatttttatatgtagtctttttttagcactcatcaccagtgagtgctaacacatttattataataaagaatgtcttctgtaatttcaagtaaaaacctttaaaaatttttacgctttcatgatcttttttcaactcagattctttccttttcatcgaaaaagaagacttgtgttacaataaatctagttcttttagtaaaggggttttcgttacttgaaaaaacaatattggtacatcatcttaacgtatatattggtgcaggtttctgcgtttccgtatgtgttcattatgaagtggttaggttacattcagacaccgatgacacaagcagagctctctaaattgtcaggtacatggacaatcatcagcttctgtgtcggattaatcattattctgctcatccttcggactgtaccaagagcttcacttcgaaatgaagcaccggtttcagtcggcgcggcaatcgtttggatcattgtcggtttctttctttccctcttagcacaatcaattgcgggggcgattgaacaatatgcatttggcattggccgagaatccgaaaatactcaaaacattttagccattatggatgcagttccatggcttgtaatcgtcatcgccctgattggaccgatattagaggaaattatttttcgaaaaatcatctttggtgtggtttatgaaaaaacgaattttttcattggagcacttgtcagttcagtggttttcgctgctgtacacaatgattttccccacatattgctctataccgcaatgggctttacctttgcctttttatatgcgaaaacaaaacgaatcattgttccaatcggtgctcatatgctgatgaactcgctcgtcattcttgtgcagattgagccagtacgaaaaatgattgaagaacaatctcaaacgatgcaaatgattattggaggctttttctcatgagaaaccctgtcgtatggggcatcatttattttgccgtaggtgtggctttcacctatatggccattcaaaatccaggtgacatgtggtcattttacagcattttgctgatggtgtttgcggcctataatattaatatctcgctcaaaatgtttgctttctctgttaaacttaaaaaacagcagcaaaaataaatcaaaaaccattttccgcacgtggagaatggtttttttatggaggaccagttttcatggaacaagaaaaactgaacatcttaaatgagcagcatgaaacgattggagttacaacccgttcagatgtccacacccaaggcctttggcatgaaacctttcatttctggcttctcaaaaaggaacatgacaccatgtatctctattttcagctaagaagtcccgccaaaaaggatttcccttctctttttgatatcaccgcagcaggtcaccttcttgcaaatgaacagccttctgacggtatgagagaggtagaagaagagattggttttactataccttttgaggatttgacctttgcaggagttatacaggatgaaatccatctacccgatttgactgatcgtgaattttgccatgtctatctttacgtccatcaagaagagcagatgaacattcaattacaaaaagaagaagtcgctggactttacagagcaaagctaatggatgcacagcagcttttcacaagaaaatgtgaaaacatgcagctggagggctttgaaattgatgaaaccggagaacgatgtgaggaaagcagagtagtctgtatacaagattttgtaccgcataagccttcctattatcagcatctatttcaagcgatcaatcaattcctttcataatagaaaaagcatcgtgacccttatttggatcacgatgcttttttatgagacatcataactttctttctcctctgtctctgtttgctgcattttgcgatatgtcactctcgaaatgacgatactcacttcgtataaaacgagcatcggcaaggtaaccatgaggtgagaaacgatctctggcggtgtaatgagtgcggcaatgacaaggaggacaaaataggcatacttccgtatttttgataaaaacatcggtgtgatgatgccaagtcttgtgagaaacatcaacacgacgggcatctgaaacaaaaagccaaatggaagtgttaactgcatcagaaatgtaaaatactcatgaatcccaatcacttgctctacatttaaatcattcgacatccgcatcagaaaatcgacgacaaacggaaacaaaataaaataagagaaagccacaccgctcaaaaataaaagcagtgcaatcggaatataagcaagtgtcacctttctttctttttcatataagccaggactcacaaacgcccacagctgatacaaaatcacaggacacgtcaaaatcaaagcaatgacaaatgcgaactgcataaacacgtacagcggatctgtgagcttaaatgcatttagtgtcagtgtggccgcttcatcggtattttgtaaatacacaatgaccggcttagcaagaaaaaaaccagccaccataaaggcgacaaaaaacatcgcaatgatcactaaacgttttcgcagttccacaatatgctccataagcggcatatctttgacattcatgaagctcatcctattctactgatcttcttttttcttactttcttcctgatcatcagctaaaccctttgtggcatttttgaattcacgtaatgtatctcctgctgctcttcctaattgaggaagctttttcggcccaaaaataatgagcgcaacaatcgcaatcagaaccaaacttccaggaccaatcggacccatttgctccaccccctttaccccttttcgtcaatcctcctgtgtaatagagtaatgctttaagaaatacacaagagactgaagttcaaccgccaaatctatatgatgaattcgaatgtgttccggcacattcaatcgggccggcgtaaaattaaggatccctttgatgccaagggcaatcaaacgatctgtaatgggttgagctgctacagcaggtactgtcaaaatggcaacaggaatatctcctacctcttgaacatgctcttcaagcttatccaaatcatagacaggcacgccgcctatctcacttcctattttactctcattgacgtcaaaagccattgaaatttttgtattattgtttttgatgaaattatagtgtaaaaatgcagtccctaaattcccgacaccgatgagcatgacattggtcatttcatcttggtcaagtgtttttctaaagaaggtcaaaaggtaatcgacattatagccataccctttcttcccaagtgcaccaaagtacgaaaaatctcggcgaatggtagcagaatccactttgactgcatcactaagctctgctgatgacaccctttgttttcctgatgcatgcagattttttaaaaaacggtaatatagcggcaaacgtttggctgtcgcttgtggaatttttgactgatctatattcatataaggtcctccaacttaaatatcagatgctctgtgaaaatcaccgtttttcccgcctgtcttttcaattaaataggtaggaccgatgatcatgcctttatcaatcgctttgcacatgtcgtaaacagtcagtgcacatactgaagcagaagtgagcgcttccatctccacacccgtacttccttttgttttcacttgtacttgtatgttcagaatgtgcgcatttccgtcttcctcccaatcaaaggagatatccacaccttttagtgcaagcggatgacacattggaatgatggtagatgtttgctttgctgccatgatgccagcaacctgtgcaacagacagcacatcgccttttccaatttcacgttgctctattttatgaaacacttcttttatcatacgaacacttgaaacagcaacagcggttctcacggtagacgatttgtcactaatgtcgaccatctttgctcttccctgttcgttaaagtggctaaattgactcatcttttcaacgctccctcactcaaatgatacactattttttcctatctgtctttcatttgaatatggcgattgtatgtatcatttgctggtttactgctgataagctacacttaacatattatagcagaggtgaagttacatgatgattctacaagtgaatcagctgtccaaatcgtttggtgctgataccgttttaacgaatataaaattggaagtcaaagcaagggatcggattgccattgtaggtcgtaacggcgcaggaaaatccacccttttgaaaatcatcgccggtcaattgtcttacgagcaaggtgagatcatcaaaccgaaagacctatcgattggctatttagcacagcataccgatgtgacgtctacacgtacgttaaaagacgaattattatcggtttttgatcatttgaaaaagatggaacaagagatgagaaccatcgaggagaaaatggcttcctccacaagttcggagctggattccctcatgaaaacctatgacaggctacagcaggaatttaaagatcaaggcggctatcaatacgaagcagacgtccgctccattcttcatggactcggctttagtcactttgaagatgagacaaccgttcaatccttaagcggcggccagaaaacccgtctagcacttggaaagctcttattaataaaaccggagctcttaattctggacgagccgacaaaccatttagatattgataccttatcatggctggagcagtatttgcaaaattatacaggcgccattctgatcgtgtcccatgaccgctacttcttagacaaagtggtgaaccatgtatatgaagtctcaagaactgccatgaaaaagtttgcaggcaactatagtaagtatcttgatctgaaagctgagcagctagagcgcgatatgaaactttacgaaaagcagcaagaagaaatctcaaaacttcaagatttcgtagatcgcaacctagcaagagcctcaaccacaaagcgcgctcagagcagacgcaagcagctggaacggatggatcgtatagataagccattaggtgatgaaaaatcggcaaactttcattttgatattgcgagacaaagcggcaatgatgtgctgaaggtacatgatctcgacattcgttatgatgaaaaaacaccgcttctatcctctctttcttttcagatcaaacgcgaggatagcgtagcactcattggtcctaatggaatcgggaaatcaacccttttaaaaacgttaacgaacacattaaagcctgtaaaaggcgacatcatctttggatctcatgtcacaatcggctactatgaccaagaacaagccaaactgacatcctccaaaaaagtgctcaatgagctttgggatgactatcctcatatgaatgaaaaagaaattcggacatgtttagggaacttcctcttttccggtgacgacgtcttaaagcccgttcatgcattaagcggtggagaaaaagcgcgccttgccctggcaaagctgatgctccaaaaagccaatttcctgatacttgatgagcctacgaaccatttggacttagatagtaaggaaattctagaaaatgcactgattgattatccaggaaccatcttatttgtctcgcatgaccgttattttatcaaccgtctggcaacgaaagtattcgagctgtcgccaacagaaacaaaagagtatctcggtgattatgactactaccttgaaaagaaaaatgaacaattagagcttaaggcgattcaagaaaatgaggcgcttaaaaaacaagcagcaaagcccgttgaaacggcaaagctttcttatgcggaagaaaaagaactgaaaaagaaagaaagacaaaagcagcgcagaatcgaggaaattgaagagcggattgctaacattgaagcgaagcttggtgaaaatgaagagcttctatgtgatcctgccatttttcaagatcacgagaaggtccaaaacattcaaacagaaaatgatacgcttcatcaagagctggaatcccttttcgcagagtgggaagagctatccgaatcttaaagagtgccctaatgggtgctcttttttcttttagtgaaaatttattatccacattagtatccacaataacttctttattattcttttaaaaattggacttatccactttatccacagagatttaatcacatatccacatgaaagaccgtgtttgtgcacatccacttcattttaaaacgaaattttctaataattgtggatatatcacgtttacatgtgaataaatcgctttcattaaaaatgaaaaaaacctgtgtatccacaggagttttcattcatatgagacaagcggtaagcccggctggccattcattgccatatcgcctcttatacctttttcaaacgcaatggttccagcagcagcgatcatggctgcattgtctgtgcaaagagataacggtggaatgatgaccttcacgtcaggaatctttgtgaatgctgtcgttaaggcttctctcagtcctttattggcagcgactccaccagctaggacaacctgcttgacaccataggcctcagccgcttttaatgttttcccaacaagcacctcaatgacacttgcttgaaagcttgctgccaaattctctggagcaattgtttctcctttttgagatgcgttgtgtagtgtgttaataacagctgattttaatccactaaagctaaagtggtaggaaccttcttcaagccatgcacgaggaagcttaatcgttggctctccttcatgtgctaaccgatcaatatgaggtccgcctggatacggaagacccatcgtccgggccactttatcgtaagcttctccagccgcatcatctaatgtttctccgatcacctcaaaacagccgtgctctttcattagtacaagctcagtatgtccaccagagacaacaagagccaagcatggaaactgcaattcatctacaagttggtttgcataaatatgccccgcaatatgatggacaccaacaagaggaatttgatgggcaaagctcagtgccttggctgcattgacaccgatcagaagggcaccgactaagcctggtccttctgtaacagcaatggcatctaaatcctgaaagctcatattggcctgtgccattacttcttctaacacgatggtgacttgctccacgtgatgccttgaagcaatttctggcacaactccgccaaaccgtttatggctttctatttgcgacgcgaccacattcgctactatttcttttccatttttcacaatagatgcagctgtttcatcacagcttgtctctatacctaatatgaatcgatctgtttgttcattcatttatattcacccacataaccaatgcatcttctccattatccgtataataattctttcgaatagaagctggtctgaaaccaagcttttcataaagggattgtgcaggtgtatttgaaacccgcacctctaaagaaagatgatctgtctttttttctttacaaaactccatgacatatcgcagcaatgcttccccgtaaccctttcctctatgctcagggagaatcgcaatgttcgtaatttgtgcatcgtccatgacgatccagaccccgcaatacccaacaggctgctcatcttcttcaatgaggaaataatggctgtactggttatgaagaatctcatagacaaatgattcttttttccaaggggcagtaaacgaatgcacttcaatcgtatacacctctggaatgtccgctaccgtcatttttcgaatctcggttatgttgagattatttttgtccttcaagccatttcacttccgcttctgccatacgaatatagttaggaacaagctgatggacatcttcagcaggacgatctgcccctaaaaacgcaagcattgaaggtcttgggttatgaaaagctccctctgctatcacagccgtttctcctaaaatggagcgaatgctctcttcatgaagatgcacatcctgtccaaggaataggacaggctttcctgtctgcttcagctcatgaagccaatccgtgagcaagatattttggtcttgtttgatctcttggatctttccttcttcaaacgtatatagtccagtataaacttgtcctcttctcgcatcaaatagtggtgagatccatccatcaaagtattgaccatttgccgcaagtgtttctaaactcgaaacagccgatatcgggatagacagcgtccatgcgagtgtttttgcaatggtcacaccgattcgaacaccagtgtaggaaccaggtcctttcgctacaacaattttacttagctcacttggggctacaccacattctttcatcaatgcctcaacagtcggcattgctcggacggaatggttcttttttaaatacgtaatgctctcaccaatcactgtggaatttttgacaagggcaattcctagtgtatggtttgacgtatcaattgccagtatggtcaaattctttcatctccttacaaagggcctcatagcggtccccttttgcactaaacgtgagatgacgttcttcttcacgttctgttcttagcatttctattttcaaataggaggaaggcaattgaggtccaatgagatgtgcccactcaaccaagcatacaccttcgccctcaaaatattcttcgagcccgatatcttcttccgcatcttccatgcggtacacatccatatgataaagtggcagtctgccatcagtatattctttaataatcgtaaaggtagggctgttgacgatacgggtaatccctaagccttctgcaaaaccttttgaaaaagtcgttttgcctgcgcctaaatccccttctaatgtcaaaacatcgcctggcatcacaagtttggccaatgcagcggcaattcgtttcgtctcatccgcaccttttgtcgtccacattaatttcactgtggatgtcacctcatttcttaaaatgattatatccttttttcgttaacattgtttgctgttcattatcttttaatagaacgcttgctgtttggccatctttgacttgtccaatacgggtgatgtaaatgtgttcttttctgcattgcatttcaaagctttcccaatcagcctctggaatcgtaccagttaatacaaagtcttccccgccaaataacacccattccagccagtctttacgcagcactggtaaatctggatgtatggggagcttgtttgtttctatctctatcgtcacatgactcgcttcggctatctcattcagctcactcgctaatccatcactcacatcattcaaggcgacccgcgggaagcttgagcaaatgagaccagcagtaatgtgtggctgaggctttttatgacgctcaagaaaaaaagctgtgtcgactgccttgggaggggctacttcgttcattaaaagtgataagccagcagctgatgaacccagctcacctgtgacaaagacgacgtctcctgtctgagcactgtgacgataacaagcttttccctttggtacttcgccaatgaccgttactgtaatgacaaagtcactgcgagtggccaccgtatctccaccaatcaaatccatttgataagtatcagcgagtgctttcattccctcgtaaagagctgaaacgaccgtctcatcaccatgaggcggaatcgcaattgatacaagataatactttggggttcctcccattgcggcgatatcactgacattgaccgctagtgctttaaagccaatctcaaaaggtgcggaaaaatcaaagcgaaaatggacatgctccaccattgtatcaacacaaacgacctcttcacaatgtgaatgaggttgataaacacttgcatcatctccgatgcccataattaaagaacgctgatgtgtttcttttggtgtaattcggcgaataagatcaaattcatccataaaaagacagccccttcatgcaatcaattgattgaatagacacgatgtcagacataattagtattagtgtaagccaatatgagtttcagtttcaattaaaaatgatataaagaaagcctggtatgaaaaaaccaggctgggttgaagtgatctatctttttttacataacgtgtagccaaacacaaacccattcaatgtatcttggatacgtatgaaaagaaaaagacataaaaaaaaacgaaactatacgttttcgtttacaagtcataaaaatggcggtccggacgggactcgaacccgcgacctcctgcgtgacaggcaggcattctaaccaactgaactaccggaccattttggttgcactcaatgagcactcccattggtatataaaataatttggttgcgggggcaggatttgaacctgcgaccttcgggttatgagcccgacgagctaccgaactgctccaccccgcgacgatataaatttaaggacgccgccaagctttttgtttatatccttccaatggaagaagttactttatcattccgcagtagctcagtggtagagctatcggctgttaaccgatcggtcgtaggttcgagtcctacctgcggagccatgcttccatagctcagtaggtagagcacttccatggtaaggaagaggtcagcggttcgagcccgcttggaagctttcctctaaattataatgatgaatgtttaaggtttctcgatgatgagaaggctttttttgtttgttttaaaaatgttgaacttgctcagtgacaagtagactcatgaaaatggaataaatcgattgataaggaagctttgtatcaattttctacgcattccttctttttgttcttgattccttagttcctttcttatattcttactaaagtgatgatatcctctctaacaaaagactctgtacgttcctctttttccccgaaagtgaagcattttttattttcctttcttcatcccaggtttgattgatcttcttttccgtgtacggtatgtatataaaaaggagtagatggtttgaaagatttatttgtaaagcaagaatggtttgggcttgtgcgtcaggatgtgcttgcgggtattttagtggctctcgctttaattcctgaggcgattgcgttttcgattattgcgggcgttgatccgaagattgggttgtatgcttcgttttgtattgccattgtgatttcgtttgttggtggacgacctggtatgatttcggccgctacaggggctatggctctagttatggttaatttggtagccgatcacggactgcagtatttgtttgcggctacaattttaacaggtctgattcaaatagtgtttggactttgccgagtgtctcgtctgatgaaatttattccgaggtccgtgatggttggttttgtgaatgcgttggctattatgatctttatggctcagcttccgcatttcgttggggaatctatggctatgtatatcatgacgggtggtgctttgctaattatttatttattgccgatggtgataaaagtgataccttctcctctcattgccattattgtcatgacgatcattgctgtatttggacatattgatgtgagaacggttggagatatgggagagcttcctagttctttgcctgcttttctgattcctcaagtaccgtttagctgggagacacttgctatcatttttccttattctttagcgctagcgatggttggtttacttgagtctcttttaactgcacagattgtcgatgatatgacagagacgtctagtcgtaagaacaaggaagcgagaggacaagggattgctaatgtggttgcagggttctttggtggtatggctggttgtgcgatgattggtcaatcagtgattaacacgaaggcaggcgggcgtggccgtctttctacctttgtggcaggtgcatttctaatggtactgatttttgtactcggagatgtggtggttcaaattccaatggctgctcttgtggctgtgatgatcatggtctccgttgggacattcgattggagttcctttcagcagctaaaaaagaatccgaaaacagattctattgtgatgattgtcacggtggtgacggtggtgttaactcatgatttatcaaaaggtgtttttgcaggtgtgctgcttagtgcggtattctttgtggccaaaatatcgaagcttcatattacctctacagaaagacaagcagggacttgggtttatcgaattaaaggtcaaattttctttgcatctgtcactgatttcattcaggcgtttcatcaggggacagatctccaagccgttgtgattgatttatctgaagcgcgtatatgggatgaatctggcgtggcagcgatagaacgtataaaggagaagtatcaagcagctggcgtacaagtagacatcgttggaatggatacacaaagtcgaaaacttgtgaatcaggtaaatggttcataataagttctttctgtttgttacaatagaaaaggtaagaaagtgaaggatgggggtggccggcatgcttgtgcgtttgaaccaagtgctcggccggatgatgccgcttattacgcccattagtgtgttacttggtgttttattagcggcttatttaaaggattttacgtttatggtgccttgggtatttgccattatgacattttcagggagcttatcgtctactttttcatctttaaaacatacggtgatgcatccattgcctttgattttatcgtttatgattttgcatgtgctgatgcctctttatgcatggtcagcggggcatttgatctttgcgggtgattccatgacgatcaccggtttgacgcttgcgatggtgattccgacaggtgtgtctagtttaatatgggcggcgatgtataaaggaaatgtcgggttaacgttatctattattttaattgatacgttgctttcgccattgattgtgccagtaagcttgtcactcttcgttggtacacaggtccatatggacatgtttgcaatcatgaaagggctgttcggtatggtggtgctgccctctattttagggatgctcgttcgtcagtatgcaaagccatcggtgacgaaaacattgagtcagaccttggctcccttttcaaaattaggcttgtttgttgtcgtatcgattaacagttctgttgtcgccccatatttgcgtgaactggatgctgcattttttagcaaagcagcgactgtctttttcattgcgatgagtgggtatgcttttgcgtggttgattggaaaggtaatgaaatgtactcaaggagagattgtggccattgtgtatacgggcggcatgagaaatattagtgcgggagctgtgcttgctattagctttttcccgcctgctgttgctgtccctgttgtgattggtatgctgtttcagcaagtgcttgctgccttgtttggtttcttactcaatcgctttgagctgaaagcacctgctgtgactaaatctttatcatgaaaagacctccatcctatgagatggaggtcttttttcgaattaatagatgagatatttcttccgtttcttttcgaatgatttgaggtcatgatgatagtgcttcatgatgtgtttgacagagttaccttgattgatttcttctttgatccaaccatttccgatgagtttatcaaagctgccagtttgaaggaactgaaagtcttttggatataaatcatgtatggctttgaggatggataaccctgtttttaccgcttcgaatgaagagcggtctgtgacgtatagctgcacaccgtgtgatagcttccctgcatgtttagaaaaagtgggggtgaatgatacaggtctaaattttacaccctttagttttaattgatttaaatgatctgctagctcattgctattgatatatggagcgccaatgagctcgaacggttttgttgttcctcttccttcagagacatttgtgccttcaattaatcctgtggcgggatatacaaaggtactatccactgtcggcatattaggtgaaggaaggacgaacggcagcttcgtgtcttcaaacgtcatggaacgcttccaatttttcattttaatgactgtgacatcagcattgatatgaaactctttgttaaagaatgttgctagttcaccagttgtcatcccatgtcttaatggtattggatagagccctacaaaagaagcgtgctcaggttctaagacagggccttctacttttagtccgccaatggggtttggacggtctaggacaacaaagggaatgttgttttctttcgcagcctccatcgcataggccatcgtgtaaatataggtgtaataacgagcgccaacatcttggatatcaaacagcaagacatctacatttttaagcatgtcaggcgttggttttcttgtttttccatagagagagtatacaggaagacctgttttttcatcggtataggattcgacgccttctcctgcttgtgcatctccgcgcacaccatgttcaggtccatatagagcagtaagcttgatatttggatgctcaaataggagatcgacactgcttttcatatttgcatcaataccagttgggttcgtaatgaggccgacccttttcccttttaaccatgaaagattgcctgagagcagtgtttcaatccctgttttgactgttgctttttttccttttgtatctgttcgttcttggtttgtgggggaggcggcagtcaatgtactcattatgagaatgcttgcgagtatgaagcttgctgtttttttcaagagaatccctcctatttgatctgtttccctttcaagttaagtccatagccgaatggatacaggatttgattttgatgagtgacagatgggatatctacaggcagtttgcctttaggtgatgcagtgccaaatatgacttctaacccagcaggaatatttggctggttaaattgtccgtttgagtagcctttaaaaccgtaaacagctagtaaggcatccgcctcctcaaaatttgccgcatcgtaagggtttcttaggctcatgatgaccatttttttgttttgtgctgcagcttctttcatgacagcacgcgggaaagccgtcgcccattttttcgggtcctgtacattgtcatcaattacaccatcattcacagctgggtcattttggacaacgtaagagccagtaatcacatattcagcaccttgtatgagtttggctgtttctttggtgaaggtcttttccgcaaaagcatatgattggatacgtacaggcttgatctttttttgtttgatcagagagtcaattgtgacagacatagcttttgtctgatcttcgtaaggtgccatgaccaagattttgtcattctttttaggcttgaaagggagggtcttattgttgtttttaagcagggtgatcccttcacgtgccattttttgttctgcgttccggtgcgactttttcccaacgacttgagtggcttttttgatttttttctcaagggtgatgggttttttggaagagatgatgcctcgtttgatcttcaattgaaggattttttcaacagattcgttgatttgagacatcggaatttctttctttacaattgcctgttttacagcattgaacacattctcaaggtttttctctgttttaagagaagtgactggtgctggcatgagggcgatgtcgacgccagccttaatggccatcactacggcttcttcctgtccgaagttatctgcaatcgctttcatatttagggcatctgttacgacaactccttgaaagcccatctcttcttttaataagtttgtgatgacttttttggataaggttgctggaaccatgatgtcctcgccatcttttttgcttttatacgttgtattatcaatagcaggaaattgaacatgagcggtcatgaccatatccgcaccagcgttgatcgcttgttgaaacggatacagctccacctttttaagacgatcgagatcatgttctacgagcggcaagccgtagtgactatcgacggctgtatcaccatgtcccgggaaatgcttaagtgtcgaaatggtcttttccttttgaagtcccttcatggtttgaagaccaagccttgtgacaagagcaggatcggagctaaaggaacggacaccgatgacggggttgtttgggttattattcacatctagaacaggagagaagtttgtattgatccctagtgcgtttaattctttaccgatgatttttcctgtgtcgtatgcgtttttcttgcttcttgaggcaccaatcgacatatttcctgggaaatgtgttcccttttgtaatcttgtgacgattccaccttcttgatcaattgaaatgagtaatggaatctttggtgatgctttttgaaattcatgggtgagtttgacggtttgtttcgtatcaacgacattctccgcaaataagatgacaccgcccagatgatatttttctacaagatgggatacttctttattcatctttgttaagcctgtaggtgcggattcatcttttgtctgccaattacgaaagtctggcataagcatttgacctatcttttcatccaaagacatgttttgtaccatttgttttgcggttggaagaggcgcagagctaaccttttccgttggaagggaagaggttagtagagctaaaaccaaagcagcggggaaaagtgcttttaacatcgaattcctccttttacttaaaagattcgtagatggcggtcatgatgcttccgtaagtgccagttgggaaaaggtcaccttcaaattgatttgggttggtttcaggtgaaacgacaggcgaatgtttcttatttgtcagcaagatgatacctagattatgttttggatcaatcaaagtcatggttccggtccagccagtatgtccataggcttcgttactagcatattttccaaacatccattccatgtcagtatgaccgtttttacgccagcctagcccgtatgttgggtttgtatcagaagaggctgtaaagagatcgatagaagcttgatcaaagatggtggtttttccatagcctcctttgttcagcatgagctggagcagcacggccatatcggatatgttagagaaaagtccagcatgaccagaaattcctgccattgagtaatatgctttctcatcgtggacttcgcctagcagggtgtacctgcgaatgttttcaaaatcaatgacaccatctcgcgaattacctaaacgttcggttgctgcaaaatgcttcggtttgaatcctttttgcagtggattgaacattgtgtgtttgagacctagcggccgatagattgtcgactctacatattgatcaagaggcatacctgtttttttctcaatgatcatgcctaacagcatgtaatcaatgtcactataaatgtgctgggtgcctggtttgtattgtagaggcaccttcggcagccatttcatcgttgtctttctatcttgagagtaaaaggtgccggctgcttctttgctataaaataagacactggaagggagtccggcagaatgggtcagaagatcttttacacggagctgatctttgccggttacctttgcatctggttcatctttaaaatctggcaggatggcttgtattttttcgttcacattcagttttttctcgtagacaagcttttgcagggcatagttggtcgcatacattttggtattggatgctaagtcgaacagagtattctttttcattttcttataggatttgagttccgttgtgccttcgtatttttgcctgtagccataggctttttgatggacgatttttccgtctttgataatgatgagtgcagctcctggaaaacctgctttgatatcgttttgaatcatgtgatcaaccttcctaagctgcctagaagaaaaaccaacttgttccggtcgttttgccttttttaagacgggatattcttcaggtgctgttttagacaaagacgatacaggatgggagctagttgcaaatgtttgtgctggtaatccaaggagcatgagcagacttgttattaagagaaagtatttcttcaagagttagacctcctatagcttatttttcctcaaattcaacagccatatcatcatgaaaaccaaataagtatgtgaaaataaatccagcgacataagcaatgaagagtccgattaagtaaagaagcatttgatgtgtgtgaacaataaaggttaatggaagacctgatacaccaatcgctttggttgcaatttggaagtaggcttgaaatgctcccccgattccagcgccaagacaagcggtgagaaatggccgtcccagcgggagtgtgacaccgaaaatgagtggttcaccaatgccgagcatccctgaaggaagtccaccggcgatagctcttttgagttttttcttttttgttttcatataaatggcgaatgcggcacctacctgtccagcaccgcccatagcgagaatcggcaaaagcgggtcatctcctatggaattgatgagttccatatgaatcggtgtcagtccttggtgaagtcctgttacaacaagtggaaggaaggtcgcaccaagaacaaatccagcgaagattccgcccatatttaatagataagttaatcctgaggtaatggcatccgatataaatccgccgactggcatgaagacaacgtacgtaaaaatgcctgtaataagtagtgtgatggttggtgtgacgatgatatcaagtgattgcgggacgaagcgtctgattcttgtttccacaagtgccataaagatagcagctagaagaacaccgataagtccgcctctgcctggtagaatatttgtgccaaatagcataatgtctgcggaggctgggttaataatgaggattccagctaatgcgcctaatgcaggagagcccccaaactcctttgcggcatttgttccgactaatataccgagatatgcgaacaaccctgaaccaataacggttaaaatgatcgccgcttgagatttttcatcaagccagcccgcttgcacgattgcttttgtaatcccagtaataagacctgatgcaacaagtgctggaatgataggaataaaaatgctggcaattcgtcgtaagaacagcttgaacggtgtgcggttcttttgtgaaatggcttgcttgtttttttgtgcttcgttgtttaaatcataggagccagaggcatttagcagttgttcaaatgcacttgatacttggttgacaacaccagtacctaagataatttgcagcgtttctgcctcgacgactccaatgacgccatcgagttctttgattgcattgatctgaacttgttcattgtcaatcggtgtaattcggagacgcgtcatacaatgtgtatgggaagaaatgttttcagaaccaccacagagagaaagaatgtctttcgccaactgctgatatttcgtttgatgactcatgttgaatccccctttgtttttcgtttcatggagcggatggcatgtcttgttttgtcaatatattgcgctgtctcttcatattgacgggaagctaagctgaggaacaagacatcaattaagtagagctgtgccattctagaggaagtggctgcactgcgaaaaggtgcttcattggaaccggacgtcgatagatgaacgtcacataaggcagaaacgcttgtttgacctggatgcgtcaaggcaatggttttcacttgattgtcttttgcgagctgaagggcttgaatgatgtctaacgtttctcctgaaaaggatataccgaacacgatgtcattctttcctgcatttgcgatgaccgttgatgcgatgtgcatgtcagtgaaggcagtcgctgcataattgattctgagaaatttctgctgggcatccgctgcgacgatgccagatgcaccgacgccgataaagtggatttggtttgcatgcagcagtaattgaacagccttttctaacgcatcggcatttaaaatagaagctgtgtccttaatcgattgaatcgagtttcctgctgttttttgaataatggattgaatcggttcatcttgttcgatatcacggtagccttgtttatcgctatgcatcaagtcgcctgcgatccgcatttttaaatcgtgatagccatccagcccgagagatttacaaaggcggatgactgcagagctgcttgcaccggccgcctgactgatctcgtgtactgtgcttttaatgactttgtcaggatgggcaaggatatagtctgcaatgattttttcagattgggggagctttgctttcattgtgtgtagtagggtgagtccacctgctgacatgagctctgcctcctttaggattgatgatgtgcgatggctttgtcgatatgaccattcgttttgttgagtaaatccttggctgctttcttgtctgtgtttgtttggagcatgacgatggcagttttgacttctaagtctgccgaatcaagcgtttttacggcttgttcgtaggaagcgtttgtcacatgttgaatgatggtgatggcgcgttcttttaatttatgattgctgacttttacatcaaccatcaagttttcatatactttcccttgtctgatcatgacagaggtggaaagcatatttaaaatcattttatgagcggatgcggctttcattcgtgttgaccctgtgatagcttctggtcctacaacgacttcaatggcgcagtctgccagttcgctaatttttgcctgttcattacagctgagggctactgtttttgcgccgatggatttagcatagtttaaagcgccaatgatgtagggtgtcctgccgcttgcggcgataccgacgactgtatcttttgatgttaggtgaatgtgtactaaatcctgtttgccggcttcttcactgtcttccacatcttcggcagcatgtgaaaaagcagagtctccgcctgccatgatgccgacaatcacatcaggtgagacgctataggtaggaggacattcgacagcatccatcacgccaagtctgccgcttgtcccggcccctaaataaacgagtctgcccccatttgaaatggattcataggcgaagtcacttgctgttttgacatgtggtaggacacggttcacagcttgagcgaccttcatatcttcttcattgatcatctggagtatttcaagcggatctgcttgtgatattcctattgtgttaggatttcttgattctgttgtcaaagaacgcaattgagatggctgcatgcgacattcctccttatttcttcattttcagtatattcagtatgatatgaaatttcaacattatatttaaatactgaaattatatttcaaacaaaaagtagtgctaattgaaggtaaatagttagaaaataaaaaaaataaaaatcccctttacaaaagggggacaacctgtatataataacttttgtcagcttcacggaaacagtcaaacttgacaaattggcccgttggtcaagcggttaagacaccgccctttcacggcggtaacacgggttcgaatcccgtacgggtcaccatgatgtggaggattagctcagctgggagagcatctgccttacaagcagagggtcggcggttcgagcccgtcatcctccaccatatgccggtgtagctcaactggtagagcaactgacttgtaatcagtaggttgggggttcaagtcctcttgccggcactgttttttctttatcaattccatatgtggaggggtagcgaagtggctaaacgcggcggactgtaaatccgctccctccgggttcggcggttcgaatccgcccccctccaccatttttgggctatagccaagcggtaaggcaacggactttgactccgtcatgcgttggttcgaatccagctagcccagttaagacaccttttttaaaaaggtgtcttttttttatgttggcaggcggaatgtataactattcaaaatattgttgagttgagtcagaaggcatcaagaaagtaaactataagcatgaacggaaaggggatgtacatatgggagatcaaaagaaggtcacgattatcggggtgccgatggatttagggcaaatgagaaggggcgtcgacatgggaccgagtgcgattcggtgtgcaggcgtaaaagaaaaattggaatcgctttcatttgatgtggaggatctcggagatattccggttgaacaaagagatgatgaaaagggtttatatacaagtgaaaagctaaaaaatttaacggagaatgctggtgcgaatcagctgctcgctgagaaggttgacagtattgtgcaatcaggttcattcccgctcattttaggcggtgatcatagcattgccattggcacacttgcaggtgtatccaagcattatgaaaacttaggtgtcatttggtatgatgcacacggtgatttaaatacagaggaaacctctccttctggaaatatacatggtatgccgcttgcagtcagtctcggccttggccatgctgatttgacgaacattggcggttattctccaaaattgaagcctgagaatgttgttttaattggtgctcgatccttagatgaaggagagcgggcgttgataagagagaaaggcattaaagtgtatacgatgcatgaaatagatcgtttaggaatgacaagggtgatggaggaagccatttcatatttaaaggaaagaacggatggtgtccacctgtcgcttgatttagatggattagatccagcggagtgtcctggtgtaggaactcctgtggcgggcggcattagttatcgggagagtcatcttgctatggagcttttagaggaagcgggtattttgacttccgctgaatttgttgaggtgaatccggttttggatgaaaaaaataaaacagccgaggcagctgttgcgttgattggttcgttaatgggcgaaaagctattgtagagcgggacttgttcccgttcttttttgttttggataaatttaaggatatattaaggtttttactggtggatatgcgtaacacgctgtcaaaaatttgttacactattttttagaggagaatgaaaccttttggaaagaggttcgtatacataaagaccggtgaaggcagaggttgaatatactatggacacaatgattaaaaagagaattaagcaattgaaaaaaggcgaccagaacgcatttgcagacatcgtagacctgtataaagacaaaatttatcagctgtgctatcgtatgcttgggaatgcacacgaagcagaggatattgcacaggaggcgtttattcgtgcctatgtgaatattgaaagctttgatgtgaatcgtaagttttctacgtggctgtaccgcattgcaaccaacctgaccatcgatcgtattcgcaaaaaaaagccggattattatttagatgcagaggtggcaggaacagaaggattgaatatgtattctcaaattgctgctgatggcattttgccagaggaagaggtggtgtctcttgaattatcgagtaccattcagcaaaaaattctaagattacccgataaatatcgttcggtcatcgtattaaagtatattgatgaactctcgttaaaagaaattagtgagattctaaatataccagttggtacggtgaaaacgagaatacacaggggtagagaggctctccggaaacagttgagagacctttgagtgaggtgattttgatgagttgtcaggaaaaaatcgtcctgcttatgcatcagtatttagacggggacattgagccccaagacgaaaaagaattaaaaagccacctgcaatcgtgtgaggagtgccgtactcattttcaacaaattgagaaatccatcgcgcttgtgcagagtacatctcatatagaagcaccaactgatttcactgcaaaggtgatggcaggtcttccaaaggaaaaaaagcgtgtgtcgattcaaaggtggatcaaagctcatccgctgatggtggccgctgccctctttctcattttgatgggaggcagtttgtttacaagctggaataccgatcataatttcagtgtgtcgaagcagccgaatctcgtcgttgtaaatgatacagtgaccgtacctaaaggggaaaccgtaaaaggtgatgtcactgtcaaaaatggcaagctgattgtagaaggcaaggttgatggaaatgtcaccgtcgtcaatggggaacagctgactgcttctgccggacaagtcactggtcaaattaatgaaattaatgaagtgtttgattggatttggtacaaaatgaaatccacagcacaaaatgtgatgcgggtcattggaccagaggagcaaaagtaatcatacgggtcgagagcagtctctttagggactgctctttttctatataataggtcagaatgtatgcgaactagcacgccagccatatatggcaactgttttccttgctgaaacaaaatgtgatataatagccacgctatgtatttacacataggctctttttttattaaaaatgcatcaaacgaagaataactgaaaattctggaggacgaggaaatggctttaggggatattccttttttgcagtacctcggtaatgctgttgatattctcgttgtttggtatgtgatatataaattaatgatggtcatccgcggaacaaaagcggttcagcttttaaagggaattgtggtcattgttctcgtcaggatgggaagtgcgtatctcggtcttaacacacttcaatggctgatggatcaagcgattacgtggggattccttgcgatcattattatttttcagccagagctaaggagagcgcttgagcagcttgggcgcggccgtttcttctcaagaagcgggacacctgtagaggaacagcagcagaaaacgatcgaggcaattacaaaagcaattaactatatggcaaaacgcagaatcggcgcgctgctgacaattgagcgtgatactgggatgaatgattacatagagactggaattcctttgaatgcaaaggtgagttcagagctgctcattaatattttcattccaaatacaccgcttcatgacggtgctgtcattatgaagcgtgatgaaattgcagctgcggcttgttatttaccgctgtcagaaagtccttttatctcaaaggaactagggacgcgtcatagggcggcagtcggaattagcgaagtgacagacagcttgaccgtcatcgtttctgaggagacaggcggcatttctgtcgcaagaaatggtgatctccaccgagaattgacagaagaagcgcttgaagaaatgctggttgctgaatttagtaagaacagcaaagatgcttcctcgaccaaatggtattggaggggcaagaaaaatggataagattttgaataatcgctgggccgtaaagcttcttgcattggtcttcgctttattgctgtatggtgcagtcaattcagcgcaagcgcccacgccgaaaaaaatcggtgaatcctttttcccaacatcgacgacagatgaagcaaccctgactgacattcctgttaaagcgtattatgatgatgagaagtacgtcgtcactggtgtgccgcaaacagttaatgtgacgattaaagggtcaacgagtgctgtgaaaacagcaagacaaacaaagaattttgaaatatatgcagatatgcagaatttatccactggtacccataaagtggagctgaaggcaagagatgtatcaaaaggactcacgctatcgatcaatccatctgtgacgacggtgacgatacaagaaaaaacaacagcagaatttcctgttgaaaccgaattttataatcaaaataaaatcaaagacggctattcacctgaacagcctattgtgaatccgaaaaaagtcacagtcactggttctaaggacgtgatcgacaaaatttctgtcattaaagcatttgtgaacctggaggatgtcgatcagcaaattgaaaaggaagcgaagctcactgtgtatgatagcagcgggaacgagctgccagtcgaattgagtccgtctgtggtgaatattacagttcctatctcaagtccaagcaaaaaggttccgtttaaaatagagcggactggcagtttgccggatgggattagtatctcaagtattgagacaagcccgagtgaggtcacagtgtacggctctcaaaaagtgctggattcgcttgattttattgatggcgtcaagctggacctaagcaagatcaaagatgatacggagattgatgccgacattcccctgccagatggtgtgaaaaaggtatcacccgaaacagtgaagatcaaagtgaaggttgcaacagcgcaagaaaaaaagatcgataatgtaccaatctctgtcgtaggtctgagcaaggatctcacctctgattttgtgagcccatcttctggacggctcacattaacagcaaagggatcaaagagtgcgattgataaactaaaggcttcagatgttgaagcctatatcaatgtcggggacttgaacgaaggaacacatgaggtcacagttcaagtgaacggtcctcaaaatgtgacttggacattatcgagatcaaaggtcaaagtgaaactgacttctaccgagacagaagatcagccagcgtctacaaatgatcagaagaaaccatcttctgatgacggtgatcaggaagagaagagtaaagaagataccacgcaagataaagcaaagaaagaatcaagtcaaagacagcggatcaaagaagataaaaaagaggacgaagcgtcctcttgaatggtaaaaaaggagcgattgaaacatgggcaagtactttggaactgatggtgtaaggggtgtggcgaatagcgaattaacgccagagctcgcatttaaaattgggagatttggcggctatgtgctcacgaaggataaagaacgtccaaaggtactcgttgggcgagacacacgtgtatccggtcatatgctagaaggagcgctcgttgcaggcttactttcaattggggctgaagtgatgcgtttaggtgtgatctcaacacctggcgtgtcttatttaacgaaagcgatggatgcagaagcgggtgtcatgatttctgcttctcacaacccagttcaagacaacgggattaaattctttggcggtgacggctttaagctgtctgatgaacaggagaatgaaatcgagcagctgatggatcagccggtcgatcaattgccacgcccggttggagcggatcttggaacggtgaatgactactttgaaggcggtcagaaatacttgcaattcttgaagcagacagcagacgaggatttcacaggtattcacgtagcgcttgactgtgcacatggtgcaacctcttctctagcgacacatttatttgcggatttagatgcggatgtgtccacaatgggaacatcaccaaacggattgaatatcaatgatggtgtaggctcaactcatccagaggcgctttctgcttttgtaagggagaagggtgcagatattggtcttgcatttgatggtgacggcgaccgtttaattgcggtcgatgaaaaaggtgatattgtagacggcgatcaaattatgtacatatgtgcacgttatttgaagggcgaaggccgattaaaggatgacactgtcgtttccacggtcatgagtaacctaggtttctataaagcgctcgagaaacaaggcattaagagcatccaaaccgctgttggtgaccgttatgtggttgaagcgatgaaaaaggatgggtataatgtcggtggtgagcaatcaggccacttgattttccttgattacaatacgacaggtgatggcatgctttctgcgatcatgcttgtcaatacactcaaagcaacaggaaaaacattgtcagagctagcagctgaaatggagaaattcccgcagcttctagtgaatgtgaaagtgtctgataaatataaagtagaagaaaatgaaaaagtaaaagcagtgattcaagaggttgaaaaagagatgaacggtgacggccgtattcttgttcgtccatctggaacagagccgcttgtacgtgtcatggcagaggcgaaaacaaaagagctatgtgatgaatatgtgactagaattaccgctgttgtgaaggaagaaatgggtattgagtaatagatagcaaagcaaatcgctagcagcggtttgcttttttttcgaataaacgtcataaatggatggatttgtacgaatcttatacgcgagggcaatttgctgttgtcttcatacataagagagcacatcaaaggtagaacgagacaagcctcatcgcatatagtgtatggaggtcttactttcttgaaagggatcacccgctacattgtgattgacggaggtcagaccttatagtacaatcatccttgtgttactggatttttattctatcaggaaaggcagggtagatgttcagaaactctcttataattatagcgcccgaactaagcgatcggacgaaagatgcttagttgacgaggatggaggttatcgaattttcggcggatgcctcccggctgatcaaaaaagagatcacagccgtaagtgtttctttaaagcaaagaggtgactctttgtacaaagggaatacacatgatctcccaaattaaacatgtagagagggacgaagaaatgtcccttctattgtagtaggctttctttgtcccttttacatgatcgggaggaagaatatttatgtgtggaatcgtaggttatattggtcagaatgatgcgaaggaaatcttattaaagggtttagagaagcttgagtaccgtgggtatgactcagctggtatcgctgtggcaaacgaagaaggcgtgcatgtgttcaaagaaaaaggacgtatcgctgagcttcgtgaagttgttgatgcaaacgtagcatcttcagctggaatcggacatacacgctgggcaacacacggtgtaccaagccatctaaatgcgcatccgcatcaaagtgcttctggccgttttacgcttgttcataacggtgtcatcgagaactatgtacaattgacacgcgaatatttacaagacgtcacactaaaaagcgacacagatacagaggttgttgttcaagtcatcgaacaatttgtgaacagaggtcttgatacagaggaagctttccgtcaaacgcttcttcaactaaaaggctcttacgcaattgctcttttcgataacgaaaacaaagaaacaatctatgtggcgaaaaacaaaagcccattattggttggtttcggagaagatttcaacgttgtcgcttctgacgcaatggcgatgcttcaagtaacaaacgaatatgcggaattaatggataaagaaatggtcattgtcacaaaagacgaggttatcatcaaaaaccttgacggtgatatcatgacacgtccttcttatatcgctgagctagatgcaagcgacatcgagaaaggcacatatcctcactacatgttaaaagaaacggatgagcagccgcttgtcatgcgcaaaatcatccaagaatatcaagacgaaaacggcaagctgtcagtcgctggcgatatcgcaagcgcagtagcagaagcagaccgcatttacatcgtggcttgtggaacgagctaccatgcagggcttgttggtaaacaatatattgaagactgggcgaaagtacctgtagaagtccatgtagcaagtgaattctcttacaacatgccgcttctatcgaaaaagccgttgttcatcttcctttctcaatctggggagactgcggacagccgtgctgtacttgttcaagtcaaagagcttggtcataaagcattaacgatcacaaacgtaccaggatctacgctatctcgtgaagcggacttcacattgcttcttcatgcaggaccagaaatcgcagtggcttcaacaaaagcctacacagcgcaaatcgctgttcttgcgatccttgcatccgttgcagctgaattaaatggtcaatctcttgactttgatcttgtgaaagagcttgggattgtggcaaatgcaatggaagcccttgtcgatcaaaaggatgaaatggaacaaatcgctcgtgacttcttcacagtgacacgtaacgcattctttatcggaagaggacttgattactatgtgtgccttgaaggctcactaaaactaaaagagatctcttacatccaagcagaaggatttgctggcggagaactcaaacacggcacaattgctttaattgaagaaggcacaccggtcattgcccttgcaacacaagagcacgtgaacctcagcattcgcgggaacgtcaaagaagtcgttgcacgtggtgcaaacccatgtgtcatctcactaaaaggcctagaagacgaaggcgaccgtttcgtccttccagctgtacatccagcacttgcaccacttgcatctgttgttccattacagctgatcgcttactacgcagctcttcaccgcgggtgtgatgtggataaaccgcgtaaccttgcgaagagtgtgacggtggagtaggttttaaataaaatctgattttttaaaaccctttagatttaattatctaaaggggtatttttgtgtctaaagaactaaataaaatgaaagatagattcgataagatcgtacatgttcaagggagcggaatcgttatgagtgaatatttaaaaaaggagaaacggggaattatttttttcttcatcctttatatcgcattgtttataagctcttatttgttgattggcgggcctcctaccgtcgaaggaccgatttgtgtatttctaggattctgtttcgttcaatttcataaatatagagccttcaaaaaagatgcaggtaataaaaagggaataggcatactaagagagcagcatatagagaaggccatacagcttgaatattttaaaaagaaagcgagaaaaacacatgaccaaacctaaaatctatacaatgagctttgcaaaagtctatcctctctatatcgcaaaggcagagagaaaaggacgaacaaaggctgaagtcgatacgattatttgttggttaacagggtacagtccggaagagctggaggaacgggtggatcaacagatagatgttgaaaacttctttgcggaggctcctgagcttcatccttctcgcagtttaatcaaaggagtcatttgtggtgttcgagtagaagacattgaggaagaaaccatgaaaaatattcggtatctagataagctgattgatgagttagcgaaaggaaagacgatggaaaaaattttgcgaggttcatcatgaccatcacaagcaagcccagtgaataaccttcactgggcttttttatatttatagaccattcgaccaataaaaataaaatccatttgaacgaattccctcttgatgtcgtcaaaagaagtgatatcaaaaacaaattggcgtttgaaaagggagtggcgtgatggacatgaagatgattttacctctcattttgctgcaagccattttaatggtgattggattgtttgatttgctgaaaagagatccatcgagaatcaggggagaagtgaagtgggtttgggctttggtgattgtatttgtggcgagtgccggtcctattgcgtatttcatttttggccgtaaacaatcttaaaaggggggattcgcttgaatatgttggagtgtcacgggctgacgaaatcgtatggtcggcatgaagtgttaaaagatgtttcgttttctgttggggaggttggatgtgtcggctttttaggagccaatggagctggtaagactacgacgattcgaattttgacggggcttgcttgtcctacgtctggtgtcgtgaaggtggcgggtatggatgtgacaaaagacatggatgacattagtcatgtgattggctattgtccgcagcagcctgcattttatcaagatatgacggggcaggagtggatgcattgggttggcgggttatttcatttagagaaaaacatcattcgttccaaaacagaggagcttttgaagctttgccgtgtgtatgaggcgaaggatcgcgttattggcagctatagtggaggcatgaagcagagacttgccattgcgcaggcactgatcaacagcccaaaagtcctcatcctagatgaacctgtgtcggcacttgatcccatggggagaaaagacgtcctgacgttgattgagcgtttaaagcatgagatgctgatctttatgtcgacccatattttagatgatattgagcgggtggcggatcatattatcatgatcaacagcggcaaaattgagatgtcctcttcgatgaaacagatcaaagaagactatatccagccagtgattgaatttcaattagaacaacagaatacgaaattagtggctttgttaaaagagcgggattgggtggaggaatgctttgagacaggagaggcttatcaggtgcgagtgaacaatcaacaaagggcattgaaggagttgcctcgtctgatcactgaatctggcggtgttctcctccattatcgcctatctgagctgacgcttgaagatattttcatgaaggttgtgactgcatgatgatgttgaaaaaggaatttagggagttattcactagttataaaatcttatttgtgccaatcatttttacgattttaatgatcacacaacctattacgctcaaaatgctgccggatcttttgtcgaaatcagctaatttaccagaagggtcttcattttatataccagagcctagtgctggagaggctttagccagtgctttgagtaaatttgattcgcttggcgtgtttatcctgattatgatcgtgatggggacgatcgctggtgagcgtgcctctggggtgacggcgatgattatggtgaaaccgatcagtcgaacgagttattatgtctcgaaactatgtgcctatgcttgcttgactttgtttagtttggtggtggcgatgcttgtctccgtttattatgtggacattcaatttgggcatctggattgggtcaatgtgttaaaaggaacacttctttattatccaaatttattgctcattgtggtatcgaccatttgtgcttcggcgttctttcaacgttctgtcacagctggcggtgtgtcgcttttgatcaaccttattttatttaccgttccttcattttatgaggatacattagggaagtttgcaccgaaaggcgtcacaagtgcggctgaggagatgattcatagagggacttattcggatcaggcacttacaagctttctaggtgtatcggtattgattggtttcttttttctcattggatggtttctttttagaagacaagaattatagcaggcggttgcgattgtttcttcaggtttactatgagcataaaaatctgaataccgttgaaagtttgataagatgataaaaattgactgtattttcagaaaaggggtttttatcaatgaaaacatcacgtaatccggaggccattcacccgccagttgcaccctacactcatcaaatagaaacaacagggccgcagcggtggttaactttatcggggcaagtggggatggaagtcgatgagaacatctcagcaagcccgatggaacagctcgagctagcgttagagaatgtaaaacgaaatgtagaagcggcagatatgaaagtagaagatataacgaagctagtattttatttggtaggtgagtttgatgccgagagcagaaaacgaatcatgggtcagtttttaggggatcatttgccttgtatgacgatgatttatgtggtggctttggcttctccagctttaaaggtagaggtggatgcgtgggcgtgtcgggatatggattgatgaaatggttgtttatatcagttgaatatgctaaaaattgtataatagagttttaaaaaagaggtggttttttgtttcaatcaaatcaaaaattgaaaaaagtgtggtcttttatgcaggtgttggagctgttttgctgattctcatgctgctgaaatggctgccgatttctgccgactgggagttgccattgattttgttcgggttggggattttgttttatgtgaagcgtgtgctttggaaggaagaaaaaagtcataacacatgagtttctgtctaggtgaatctagaaaggtggagttgattaaatggaatgaataaaagattggattcaacattcaatcttttattcatttttttggaaatgcttttactgctttagagcagtgtttgaatcaaatttctctaaaaattcaatgtcctccatgtatttaaaatagcgtttgatcaaatggttatccatttggggataggtcattccatgtgcttgtagaaccgtttgagtatttgttgagtcaaagtgcgccatgttttcgtagagttcccagactgttttgtctcgttctaccttttcagagagcattggaagaaatggcgtaagggcgttgtctgcatgttggtcgcttgctttaatgagtgcttctacccaatcgttatatgatatcttttctaatggatagcctatttcttctgttattttttgaaaaaactcacctaattccatgctttcttcttgaggtgggacgagatgataggctttgccgaagttggctgggtctttgcatatagttgtaatggcttttgagacaaagtcgacgggtacgaattcttttcgttgattcggtagctcaccgtaagcctttaactggatgcatcctttgatcagccttgccatgtaatcctctgtattattaacgcctgtttgactgtcgcccatgatgaagccggggcgaagaactgtgataggcactccgcgtttttttgcttcccacacgcgtttttctgcgacccatttgctttgagaatacccaatgtccttttctacaataggaagataagcatcaatggatgtatcttcaaaaagaatggtcgtcccatctagatacccggcaggcccaaatatggcaatggtcgataggaaatgaataggctttacctgttctgtgcaggcgagtttgatgatattttcagtgccggtgacatttgtatccttgtgcatgtgatagggctgaacgtaattgacttttgctccattatgatagatggcatcaatggtttgggcgagctgttgaaattcatcggttgatagtcctagttggggcttgtccaagtaacctacaatcggctttaggtgtttcagataatgttcatcccataggtgatatttctccatatttacttgtattctctgtcgtgcgtgctgcttgtctcttgctctgacgacacaataaatttgaatggtgggatgcatctgaactagttctttgatgagataagcgcctagaaagcctgttgctcctgttaataacacggcattctgtttaaatgaactagatttgaatgggtgtgtaggctgaatgtctccgtctaaaaagccttctgatttgagcttttgtttcgtctgaggagtttgttcttgtagcaaacaattcattttttttatggtgggatgctcataaagggtgctggcaggtaattcaacgtgtaatgtttcctgcatacgcattaaggttttggcagcaaggatggagtttccccctaagtcgaagaagtgatcgtttgtgccaatgggctctacctttaataggcctgtccatatttcacatagtgcttcttcgatttgattggtaggtgcgacatattcagtttgcaggctgggcctgtcgaaatgatatcttggcagtgcttttcgatcgactttcccattcgtcgtcgtagggaaggctgtcaatagtacataatgtgcagggcgcatgaaatcagggaatgtttgctttgcataagattgaatggtatgtagatcccatgtctttttgttgaacggaatgatgtaggcaatgatgcgtttatccccaggtgtaacctcagtggctgtcactaaacaggatttaacacttgggtgcttgatcagcacatgttcaatctcgctaagttcaatacgaaagcctctaattttgacttggtcatcttttctaccaacatattcaatcaggccatcaggttgttgtcgaacaagatcccctgttttgtaataggttcttccatcccgctcgatgaaacgttcttttgtcaggttttctctttgccagtagcctaatgctagtccatctcctgaagtaatgagttcccctatttgtccttgagagacagattcaccttgttcattcgtgatgtcaatgatggttcctgatactggtctgccaatcggtatactgactagctcatcccatgtgtttggtagttgaaaagttgttgtgaaaattgtattttctgtcggaccataaccattaatgatggttgtatttgggagctcttttaatgcttggtgtatgatttgaggtgacatgacatctccaccagagacgatgtatttaactgatttgacatcgttcagatgtgattccatcatcaagttgaacaatccagtagttaaaaagagaatagatacatcatagtctttaatggtttgactaacgagttcaggagtcagttttccagaaggaggaatagtgagtgtcgctccatttaataaagcggaccatatttcaaatgtagaagaatcaaaagagatggtagatagtaatgctaacgtatcagaagaattaacgggcagaaaggaaggattatgcgttaggtgcatgatacacctatgggtaatgacaacaccttttggttttcctgttgtgccagaggtatacatgatataagcgacatcagaagatttgacatcaaaggacgggtttgacgttgattgtgtaaggatgagatgttcttctttatctaagtagatggtagggataggcaacggggtcacacttgatgagacatgtgatgttgtgagtaaaaaggatagttcggcatcttcaaccataaattgaatacgttcactagggtagtgtatgtctataggcacataaacggctcctattttagtgatacccagtatagagacaatcaattgtggtgatctttctaaggctaggccgatatgagaagcttttgttacacccattttgatcagataattggcaaactggttactttgttcctcaagttcagcatatgtgatgttctgatggttgcatgctaaagctgtatgatgcggtgtgtgggtggcgtgatgtctcacgatttcacataaattttgaacattcatgatggtattccccctctagaatttgatagattaggaaccttattcctaaatccacccaaagtgtatatgaagaaatatccattgtcaatgcagagatgtgttaaattaaatgttaaattcatacaataattgaattgatgagtggatattattttcgaaatcaggaatgaatttaaggaatttgtgactttagtcttgaatgagtattgtcactataaagatgaaaattgaaacgtgagaggatggttcaaaccagtttaatgataaggtgagatattacatttttattagaaatatagttacatatttcaataaatttttggtaaaatatacaggcatatcttaaatttgttatatattttttaaggagctgtcgtgttgaagggatctagggttgagttaattgatagtttgcgtggttttagtttattaggtattttgatcgtgaatatgcttaattttcaatatgattatgattttgagaaaatgtttgattcgagcttttgggggcaggaatttggcgtttatgtaacggaaattttgttccaggggtcgttttatccgattttctcctttttgtttgggtattcttttatcaaactgattgaatccactaaggccaaggggctgaatacgaatgctattgtcgttcgccgcggctttggtcttattgtgcttgggatgctgcattacatatttatttggaatggtgacattctcatgtattacggtgcatgtatgtttttcttgctgatgtttttaagcagccggatcaaaacgatgctgatttggtcaggggtgttaggtgccttgtcattggtggttttaccatatctgatgacctttgtttatggaaatgatgatttgttaactgatgtgtatgcgaagggtgcatacggtgatattttgttgagccggattacgattgaagacgatatgatgattgtgaccattattatggcgatcgtgaccattacgctgatgccaatcttaggttttctattcggtacgatcatggtgggtccatttgcactgcttggcatggccattgggaaaaaaggtcatttgacagaagaagatcgaggcatggcttatcgtaaaggctgggttgggatgattatcatcgggctcgccttaaaatgtgcgacgttcattgatgccccttggagtgaaatggtgatgacgttaggtgcctatgtgctggcgatcgggtatattcaagcttttattgtgttttactattcgaaggcagcccaaggcctcaaacgtctgcttgcagggcttggccgtttgtccctatcaaattatttggcgcagtcgatcatttgtacaacgattttctattcttatggacttggtctatttggacagatggggtcaatgtttggactgctgctcgctctcggactgtatactgcacagctgttcatcagctatgtctatttgaaaaaatggagaagaggtccggtggagtggatgatgggaaaatgggtgtattggagataaattttttggggaaggccgcatagctgaagagctgtgcggtttttttagttgtattgcaatcaaaaaatggttgattattctcctagtgtgtatataatgtatatatagtgtatatacaatattttgttccaaacaccagtacagaaaaaaagaggtttttatatgcaaattacgatttcaaaccactctaaggagcccatctatgagcaaattacgaatcaaattaaatcgatgattttaacgggtgagctggcggagggcgcggcgctgccgtctattcgaaagctggcgaaggatttacaaatcagcgtcatcacaacaaagcgtgcatatgaagagttagagaaggcaggatttatttattcgattgtcggtaagggatcatttgttgccgagcaaaacctagaggtcatgagagagaaaaaattgaaggtgattgaggaacagcttggagcggttgttacaaacggcaaggaattaggcttatcttttgatgaattgcagcagttattaaagttcttgtatgaggagtgagatgagtggagcatgtgattgaattcaaaggagtatcaaaacggttcaaagacttttctgtgcagaatcttgatttacaggtcaaaaagggctttgttactgggtttattggagaaaatggagccggtaagtcgaccacgattaaaatgatcatgaatttgttaaaaccagattcgggtgaggttaaaatttttggattagattatcgcacccatgaaaaagagattaaggaacgaatcggctttgtttacgatgctaacgtttttttcccaggattgaatttaaaagacatcaaacgaattgtggcacctgcctataaacgctgggatgaccagcttttttatcaatatattgaacagtttggtctgccgctgaataaagcgatcaaaacattttcaaaagggatgcagatgaaggcgtcacttgcgattgcgctgtcgcatcatgccgagctgattattatggatgagccaactgctgggctagatccggtctttagaagagagctgctcggcacgttacaagaattgatgattgatggaaatcgaacgatctttttctcgacgcatatgacgactgatttagatcgcatcgcggattatattgcgtttatacaaaatggaagattggtctttcaacagtcgattcatgaggtggcggagaattatgcgctggtgaaggggagcctggatttgttggatcgagacacagaaaaggcgtttatccatattcagcgtacggcagccggatttgaagcattaacagatcggattgatgaggtgaaacttatttttggggatgctgttgtgattgaaccggcgtcgcttgaggatatcatgttttatttgaaaggcggggttgcgcatgtttcatttaattaagcgtgatgtgattttgcaaaagaagcagttacttatttttattccgtttatcttgttttttattttcatggatgtccatccagtattaacgtttctagtggctagtgtcttcattccatttaacacatatgcttatgatgagaaggcagaaacgaatatcctcttaaattctttgccttatacacggaatgaaattattgcatcccgttatcttggtgccgttttttatatggtcattgcgatcgggctgacaagtgctgctttctctagttttgggaagctgttttcgataacggatattgctcttggcagcgggttgtttttattgtttgcggcgtgtacctttccattattttatatcttaaagcctggttatatcacaacggtagtgctcattggctttattctattatctgctatgggaccgcctgttgttctctatttagcagagcaattcagtgggattactgattttatcatgaatttatcgatccctattgtatatacggggtcaactgtactgattatgctcatctacttgctgtcttggggactttctactgcgatttaccagaggaaagtgttttaaatcagatgatcacatcatttatagagaatcattcattttgaggtaggcctttcaaaatggatgattctttttttgcatccggtgaaattgacatacagaagaaaagaggttattgttaattaacataatgttaattatttttaacatattgttaaataaatcatcctttaagaaaggaatttgaaatggagattaaaaatagaattaaggtattacgggcagaaagagactggacacaaaaggatttggcagagaagttaggtgtgactcgtcaaactgtggcagcgattgaaaatggtaaatattctttgtctttaaaattagcatttcaaattgctaggacatttgaagttgatttgtatgacgtatttcaagaggtcgacaaggaggaacaacaatgataacgacgatcatactttattctctgattaccctttctgttttaagcacggcctttcaatttaagaaaaaccgtgaatataaacatgatgaacgaggtcaatttattttagcgaaagcaggaagtttttccattataggtgtggctttagcctatatattggttgctgtcgttcaatctttggtccatcaattctcatctccaacagagtggttttatatagcgattacgtttatgtatgtatcaagtgtttgcgcaaatacaatcggcatcatctattgtgaaagaaaatattaattttcatcgatggatgtaagctagagttcttcgtcatgaagggaagagaaaaccaatgaaaaaaatattgagaatcatgttgatctccataggcaccattatcacggtcatggttgtttttctagctactgtttattttgtaaacctcattagtaatgaacgggagaaagggaaaatagaagcttatgggcaaaaggtcttggtggatgggaagcaaatgaatgtgctcattcaaggtgatgggaaagaaacgattgttcttctcccaggctatggaactgcttcaccagtgctagatttcaagcctctagtagatgaattatcaccttattatagagtcgtagtgattgaaccatttggatatggtttaagtgacgatacagataaagtacggacaagtcaaaacattgtagatgagattcatgaatgtttgcagaagctcaacattaaaaagtatacgatgatgggtcattcgatctctggcatttatggattagaatatgtgaatcaatatgaaaaagaagtcaaagcttttgttggaattgacagcagtgttcctaagcaggaggatgcagatgaattgccagtttccagcttacagctgcttcatcaatccggcttttacagattgatagtgaaaatgaatccagatcaactggtgatgcctaaagtagatgatcaaacgaaagctcagattaaaatgctgactttccgaaatttcttggatgaaagccaagctagtgaggcagaaaacttcacgaataattttaaacacgcagagcgcttacatttccctaagaatctccctgttgttttctatctagcagatcaaacggaagaagaaacaccaagctggaaaccaatgcatgaagatctcctgaaaaatgtagatcacggaaaagtagttactttcaaaggcggccattatttgcatcatacgaaatcaaaggaaatcgcagctgattttagagaatttctaactaacaacgagagtcaccgttagtcatataccttcccggcatcatctagttacccaagtttattgaacaatattttcattttctcgtgttaaaaaagagaccgtgtgagcggtcttttttttatatacagaacctatattgacagtttatcatgaagtagattaaaatacataccaacagtcggtatgtaaaaaggaggcgttttatttggctagaaataaatatccagaaaagacaatcaagcaaattttagatgtgtccacgaagctgtttcaggaaaaaggatttgaaaagacgagtttgcaggatatcatccaagaattgaacatgtctaaaggggctatttatcatcatttcaaatcgaaggaagaaatattacgtgccgtgatggagaggcaatttcgtcatgcgactgagaagcttgaagatctgattaagcatacagaggcagcgcatgcgaaagagaagctgcagcgtattttagagcagctagtggcagatccaacatctcattcgattgatgggatcttggttgaccagatcaaaaatccgcaatttgtggttgagggaatgaaggcaggcgtcaatcaggatgcgcttaaaatcaaacatcttattcttgaaggaattgatgatggttcgataaagactacatttcctggggaggtggcagaagtgtttatgctactcgtcaatatatggctgaaccctacgctatttgctcgtgatgagcaggaaactagtcagcgtttactgtttttacaacagatgatgaaaggtctcggagtggatgtggtgagtgatctatttattcaaaaggtcacagcgcattatgctgggattggtggatatgatcagcctggaacctaaatggtcagataagagacaaaggaaaattcattttataggaggttgccttatgcttcacttcgtaaaactcgagctaagaaaaagccatatgaaacattatattcaagctagtatgattgtcagtattgtactgctggtgtttatttattttgttgcgtttgttgcacaggttgaacaggaaatcggttttcagcaatatccgaatatctatttgttgaccagtatagtatggatgatctttttttcgatcgtcacagccatgatgtattgtcgagaaatagtggctgcattgaaagaacaagaacctcattcatccagtatgagatcatccctcctttcgagagtggtttggatgctctgcttttctacaattgtcatgctgtgtagtatcattccttcatttgttgtgtttagtgtcactgaaacgttcttccccattgttcaggatgcgctgacagcggatgtgatgctcactgtgatcaaaacgtacctagtgtttacttgttgtatcaatggtattggcatgattgcgatgagagtgggggtcatgaaaaggtctattttcatgaccattctgactgcgattgttctatgtgctgttttaggaaacgtattaatcgctgtttatggaaatgatcaaatgaatgtcattttgtcaggagtcatgatgatagctgtcctcatagtgatcttggaattatggggccgcatgacccggattcaagcgagataagcgagtacacaaggagggagacatatggagcatacaattctaattgaagagttggtcgaagaattatcgctggattggctgctcggagaggtgtttattcaacaccatgatcatccttatctcatcattcgtcaaacggccaatcaagtgttcccaaatcgttatttgatgcatcatcaggtaagagatggacgattgttcattaaagatagacggaaaaaaatactcagcttagggcttcaactttataaaaccgatgtcgctattattctccctaaacgacaattacagtccatttccattcgttgtaaaggagcaaatcttcaggcagagagattgaaggtggaacatgtctcttgtcatttaacgtctggaaaaacgatgctatcaggtgacatcaagcatctccatttagagactgtaggtgggcttatttctagtcgggaacttaccgtacaaagattattactgcacgccacatcgtcaaaaattgagttggcgggtgccttttcggacgttgatctgcatgtaacaggtagaaggatgcagattcattctacaaacgtgctaaattcacttaaatctacttcaactggagcaaatgtcaaagtggtgataccggaaaatgatggatttacttgttatgtaaagaaaagatccggcgctttccggaatgacttttcttgtcatcgagagaaggacaaaatggtgcataaaaatggactgtgttcctttgaagttgatataaggggcggtcagttcctattaagtgatcagctttaaagtgacttacatcctttgattcaatatatcaatataaaacaatttgagtatcttcttatgtcggaatattttgataatagtgtttccctcaaaaaaacaattgttttttaagggtagatttattatgataatatacatcgaaagattgatgtttctcaatcagaatgaatattctgattttcatttttttttatgttgtttgttgatgagggggaagaaaagtggctcaaaaggaattaaaaagagggttaagtgcccgccatattcaaatgatcgcactcggcggcacgattggtgttggcttatttatggggtcagccaaggccattcaatggacaggcccatcggttcttctcgcgtacgcagtatgtggtatctttatcttttttattatgcgtgcgatgggagaaatgttatacgttgaaccaagtacaggttcatttgctacatttggtcatcaatatattcatccgcttgcgggttatatgacagcttggagtaactggttccagtgggtcattgtcgggatgtcggaaattattgccgtaggcgcttatatgaaatattggttcccagacctgccagcgtggattccaggattaattgcgatgcttattttgggagctgccaatttgatttcggttaaatcgttcggtgagttcgaattttggtttgcaatgatcaagattgtgacgattattttaatgattattgcaggtctaggcattattttctttggatttggaaatggcgggacgcctattggcttgtctaatctgtgggcgcacggcgggttctttacaggtggatttaccggattcttgtttgcattgtcgctcgtcattgctgcctatcagggtgtagagctgattgggattacagcaggtgaagcgcaaaatccagaaaagacgctgaccaatgccatcaaaagtatcatctggcgtattttgattttctatatcggtgcgatctttgtcattgtgacagtgtatccttgggatcagttgaatacccttggcagtccatttgtggcgacgtttgcgaaaattgggattacagccgccgctggtattattaacttcgttgtcattacagcagcgatgtccggctgtaatagtgggattttcagtgcgggacgtatgctttatacattaggtgtgaacgggcaggcgcctgctttcttcaccaaaatttcgaagaatggtgtgccgtattttggaacattcgctgtgctgattggtttagcaataggagttgtcctcaattatgttgcgccaccaaacattttcgtctatgtgtatagtgcgagtgtacttcctggtatggtgccatggtttgtgattttgattagtcatatcggttttagaaaggcgaagggagctgcgcttgatcagcatccattcaagatgcccctagctccgttttctaattatctgacaatcggcttcttactgatggtgcttgtatttatgctcattaatcaggatacgcgtatttctctgattgtggcaattgggttcttaattgtagtagcgcttagcttctatgtttttgggatcgggaaacggaagccgattgaaacagcttcttctgatcaaacggtaaaataatcaaaggccttgcggtccatcccgcaaggctttttttgtttagagtgaagcttttacacggttaaagacatctggaaagttggtgaacagaccggtgacgacgtattgcattaaacgggtcatgtcggcttcgctgttgaccgtataggggtggaggaggagtccgtggcttctgacctgttgtacgttttcaagtgtcaatgctctgaaattcggtccgacacccactgcataagatttgatgaaatcgagctgatcatctgtgatgaacgtcatttgggttctgtctaaaagctgtacttttggaaggcgcggagctaatttctgtagctttagcaggctgtcttggctaaaggattgaatgatgacctgcccttttcttgtgtgtttcccgagaagatgatgtttttttagggtcgccaatagcttttcttccatttgcggatagatgtctggtttttttgtttcaatataataattttctcgtttgccaaaatagcgcagtacttcatctaatgtgaggactcgctgtccgatatagttgacattttgtctgtcgggattggcttcattaaaccatgtaccagcgtcaagctgtttgatttcagcaagtgtgaggtctttgacccagcccgttccgtttgtggtgcggtcaacggtttcatcgtgcatgacgatgagatgtccatcctttgtcatttgaaggtcgagttcgaggtaatcggcattcatctttgtggcgagtttgtaagaagccagggtatgctctggtgcataccctgatgctccgcgatgtgcaacggttagaatacgatctggagataaaaggttttcatgtgccgatacggtgaccggcacccatgcaatagacagtaaagcaaaagagagcaacacgaaagcaagtaatctacttttcttcatattttatcctccttttacggtaactgccttcatcataagaaatagatgtaaagggcatattgggcggatatgaatcttttatgtgattttcattaagcttgctctacgcgcttccctgtattccaagtcatcgctaggaagacaatcgcaagcacacaagaactaaccaataaaataaagcctcctgtccagtcgtaatggtccacgacgacgcccatcatcgcatttgcgaaggcagagccgccaatataaccgaaaaatcctgtgagtccggccgcagtgccagccgcttttttaggagcaaggtcaatggcttgaagtccaatgagcatgacaggtccgtaaattaaaaagccgatgctgatgagggcgatgttatcgaccattggattgccagcagggtttaaccagtatacaagcaccgcgattaacacaccagccataaagaggacgcctgctggtgcgcggcggcttctaaagaatcggtcactaatccacccgcacaataatgtgccgggaatgcctgcatattcataaagaaaatatgaccagcgtgaatgctctggtgaaaagccctttgcttctgttaagtaggtcggcgcccagtccacgacaccgtaacgaacgaagtacacaaagacgttggcaatggcgatataccaaaggaatttattgttgagtacatacttaaataaaatctctttcactgttaattctttttcttgatcttcgtactgctgtgccggatagtcattgcgatattcctcgattggcggaagaccagcggattgcggggtatcccggacgagaagaatgatcacgaaggagacgataatggcaatgatggcagggaagaaaaagatacttttccacgtcgcaaacagcacgatccctaaggtgatgagcggtgccagaattcccccgccgatattgtgagcgacgttccaaatggacattttcgttccacgttcactaaccgaaaaccaatgcgccatcgtccgtccgcatggcggccaccccatgccttggaaccagccgtttaaaaacatgaataagaacatgatccatacacttgacgtcacccatggaaatgagacaaataggatattgataagggctgatagaaagagtccggtggctaaaaaatatcttgggttacagcggtctgagatcatacccataatgaatttactaaagccataggcgatagacacagctgcgagtacaaagcctaattcacttttcgtgaacccttcttcttgtagataaggaatagcaaaagcgaaatttttccgcagcaaatagtagcccgcatacccgataaagatgcctaaaaagacttgaagccgcagccgcttatacgtctcatctgttttggcatcatcgagcctgtcgatatgcggagcgggtttaaaccatttgaacataaagatcctcctcttgtcgttgtccgactgactgaatcaaaagtacgagatcggcgtttgatcttgtactttttaagagacaaaagaattgataacgctttcttttgtactcccatcatatcggatggaagagacgtttatgatgaggcttttgtcattattttggaaaaacagttcatcaagtaacgaaaaaaatccgcacatggcggattttccttagctgttacagagacacattaattttcgcagatttcttaagcttttcaatttctttttgaacttctttctgcttttcttgggattctagctgctttttaatttgtgatttaacttctttgtactctggtgctttttgcttttgttttttcatttcatctgcgtattgatcatagtacgctttaacatccttttcagagacggacgctgatttgatttctttgtcgacatactggctgtatttgatgctgtcagcaatgtcacttttcagctgatccatggtgagtccgcttttcttaagggcttcttcaaactgagcgttgtctttgaattgtttcttttcttcttttagctgtttatctacctgtttgtcagaggctttaatgcccttcttctcagcatcttgcaggatgagctcttgacctacgagcgcatcaatggtttgtttcttgactgcttttgcgccttctttagatgttgggtcttgcccagattgctgaagctgtccttgaatggttgatagagcgctattatattcattacctgtgattttgtcttggttgacggtcgcaacgaccttttgatcatcgattttttgtgcgtctaatttcttttgcatctcttccatttgcttttgctgttctttttggtcagcctgtgttgtttccttgtttttggctgaatcgttttgcttatcttgtttggcatcgtttgacgagcaggctgcaagcccaacagataacaaacatgcgatgagtgtgtatgatacctttttcatcattttctctcccttcggtatgagaacatctagtgcgcattctaaccgttttttaggaaaaataaaaccgtacagacaatttgttagcggattgacatgttttttatctgtttgtcctcattttgtcttctcatagtcatctcatgacaaactcaatcgtggaataattgttccatcgcttcgtcgagattggtgattggctggcggcagctgtagttttcacaaatatacacggtggttttgccatcgattgttttgtaatcttttgtaaagggcgcgagcttcgctaattcttcccctgtttcggcagtcaatatgatatcaaatggcatgaagcgtttttgaagcgcctgtaaaagctgttctttttgagggtcgccgttttttccgagaatgatgatttctcttttcgttgcatattgagcaaggagtccttgcagaaacgctgtgtgcccgcttggataggaagagatatcgacataaaaggctttgaacattaactctaatgtgtccagccaatcctgacgtccggtcaatctgcttagcatgagaaggtgcttgagtgcggtgctgttgccagaaggcatggcgccgtcgtacacttctttttctcgaacgatgagcgcttccgcatctgaacctgagaagaaaaagccccctttttccttgtcccaaaacagctcaaacatgttctcggcaatggctgtcgccttttccagccatgctaattcaaaggtcgctttgtataatgacatatacgcttttagcatatgcgcataatcctcgataaagccaagatgctttacgtcaccttctctatatcggaccatgagccgctcatgttggacgaggtgtgtttctagaaaagacatcgcctgtttcgccataccgatcgcttcctctgcatcaaatactcttccagctttggcgagagatgagatcatgagcgcattccaggatgtgagcaccttgtcatcgataagcggtgcaggtcgctgctgtctgacagattgtaaaatgtgccgagcttcttgcagcttagactgaagcgtatggtcatcaattgaaaaagaggctttgatgtcatcaaaagaggtggaaatggtatgagggatgttcgccccttcaaagttcccctcatctgtgatgtgatagacagcgcagaataatgcgccgagatcctcgcctaaatgagtcatgatctcatcttttgaccagacgtaatattgcccttctttcccctcagaatctgcatctatcgctgaataaaaggagccatccggattcatcatatctcgcttgataaagtgaatcaggcggtggacaagcttttcatatgcaggttgttgagtgagctgatacgcttctgtgtaagcctccatcagcaaggcgttatcatacagcatcttttcaaaatgcggcacaagccatttttcatccgtcgaataacgagaaaaaccggaaccaatatggtcatatataccgccatttgccattccatctaacgttttcgtgactgcatacagcgcattctcctgtcctgtccattcgtaatagcacatcagaaatgagagcatatgaggtgcagggaattttggcgcggaaccgaatccgccgtgcagcgtatcaaagctgctcatgagctgataataggctttgtgaattgcttcttgagacagcgtgttttctgtctgccctgctgctttaatccgcaagttatttgtcgctttctcagccaatgattcaatatgatcccggtcgttgtgatacgcatccagcagttgtgtcagtgcctcgataaagccaggacgtccgtaagcactcctttttggaaaatacgtccccgcataaaaaggcttttgatcaggcgtgacaaacacgttgagcggccagccgccttgtcccgtcatcatctgacaaacagacatatacatagagtcgatgtctggacgctcctcacgatcgactttaatggaaatgaaatgctcatttaagatgtcagaaacttgttgatcttcgaagctttcgtgtgccatgacgtggcaccagtggcaagttcctttggctatccatacccaatcgatacgaaaacaggtttgttttcaagtttcgcttttttaaatgcttcatctgaccatgtgtaccagttgactggattatatgcgtgttggagtaggtagggggatttttcagcgattaatcggttgggtatttttttgtttggcatgggatcaccttctttcgtatagaaaaattattatttaatcaattatgtgcgatcttcctaattttataaagtaattccaacgataactttcctgagggtattctttacttaaatctttgcatattatgtctaatagcgtgaaagttcgtgaaagttcttctataagtaaaattccaataaaatttactgaaaaaaagcagtctaaaagcaaaaacgctatggaaattattatcgatgttttcaatccatttaagcaactcaaaacattttttcctacggttaccatgtactctgatagcaaagttagaaaaattatagagattgtcatcaattgcactaacaccgcacttatttagaatctgataaaagtgaaaatgaaatattatatcttctgttatttcaggcatttttatttttaagtcattagatattttattaaagtttttgcaaaactcgtacaataatatgaatttcaagtggttggcttgtatccaattttcacactggtggaaatttcttgtgatatgaaattgacttattaaatcatgttcagcatattttaaattttgactaatgattttcattattccttggaatttttcatttggatcattaagtttgtgaatttcttcttctgtaactctatctaaattcataagtttacttttataaataaagaaacgatattcgtgaaatgtcagctaaaaaaaattaaagcacatgattaaggtctaatttctttaccgatcgttctcaaatttgatatacttcaaacatgttagatctaactgttttgctactcaaaagagaatgatcattctttaattatttcagaatgagggagggatgaatgtataagattgtgcttctagtacatcaatgattctcagtcctttccctgaatatgttcgaaggtgggattatatggctagaaataaagaatttgatgaaaagaaggcattaagaaaagcaatgattcttttttgggaacagggctatgaaaaaacatccattcaagacttggtggatcatatgggcgttcaccgcagaagtatttatgatacatttggcgacaaacatactttatttatgcgagtcttaaatcattatgtagaaataatggaaggccgaatgaagaatgaagtgaaaacagaattaacagtgaagcagtcgatacgaaaattatttgaaatggtgattgattcgacacaacagcagccaaaagggtgtttagctgttaatgcagctgttgagttatccctaattgatgaagaagtagcgaaaaaaacgacagagatttttataaatacagaagccttattatttgatttgctaaaacatggtcaagatcaaggtgaaattcctaaacacaatgacatcaaagggctttctcaatttattcataattcactcgtaggaatacgagtattaacaaaaacgacaaatgataaagagaaattagaaagtattattaatttcactttgtcgacactagactaaatctattttgtgatatcgattagttaattaaaaatatggtttcgaggagagaatgatatgaaatacacagttattacaggagcaagttcaggtataggatatgaaactgcattggaatttgctgctcgcggcaaaaacttaattattgtagctagaagattagagaaattagaagggcttaaatcagtaattcataatataaatcctgatttagatgttattattcatacaagtgacctatcgataacagatcaggcatacacactgtataacagtttaaaggagtatcaaattgagacgtggattaataatgctggtcttggtgaatcttcttctgtgacggaccagaatttagagaaagtagaatccatgttacgtcttaatatagagtcgttggcgattctttccacactatttgtgcgagattattctcatgtagagggaacacaattaattaatgtatcctccgcacttggatatgcgacttatattggtggtattacctattctgcatctaaatattttgttagtgcatttacagaagggcttgcaaaagaactagagcttaaaagtgcaaaaatgaaggcaaaagttttagcaccagcagtgactgaaacagaatttgagaaaactgcacaggatgtagaagaatttgattacaaaaactttatgccaatgtatcacacagctaagcaaatggctggttttatgatggaactttatgacaacgataaagtcgtaggtattgtagatgaaagctacaatttcaatttaagagatcaaatctatccaatactaggcgtttaatgtattaacagaaaataacgtgttgggggtggctgataaacataggttctttgcagtagcgattcaaaaaatttaattatttgagaatgatcgttctaaaaaaacagtaccaattgaataaaaagataatgttgtgagtatttaaggtttgggtggtgggttgatcttaaaataaggttccctccacctaaacgattggaataatataagatctttataaaaagaattatattgagggtagaaaaatgaagtagacagtgaaaataataaaaataaggtaaagaaacttaattaaagcaactcaacggaagggtgctaataaaaatggaaacactcatgagagcagctcagatcaccaaatattcaaaaaaaccccatgtccaaattaatgacattccaattccagagatcgctgacaatgaagtcttggtaaaggtcaaagctgcggcggtcaatccactcgaaatgttaattattacaggtagcgtgaaactgattcaagattatgaattcccattaacgcttggtaatgaattgacaggtgttatcgaaaaagtcggaaaaaatgtgacagaatttcacgtaggagatgccatctatacacgtctccctctcgaaaaaattggtgcttttgcggaatatgccgcaattgatgctgccgcaatttcacccatgccaaaaaatttgtcttacgtggaagccgctgctgcaccactggctggactcacagcgtatcaaggtctacatgaagaacttgaggcacagtcaggtaaatctgtttttattccaggtggatcaggcagctttggtcaaatggcagtaccaatcgcaaaggcaatgggcctaaatgtcattgttagtggcagctcagaagcgcgcgaacgcacattggaaatgggtgcagtccaatatttggattatacaatagaaaactatgttgacttgttgtcgaatgtgaattacgtaattgatacattgggacctaaagaatttgaccgtgaattgagtataatcaaaccgggtggaaaattgctctcccttcggacaggtccgaataaacgtttcgggaaagatcgaaatttcccaagatggaaacaaatattattttctcttgctggtgcaaagtatgaccgcaaagccaagaaacaaaacgtggaataccattttattttcgttcgttctgacggcgcacaacttaaagatattacaaaaatcattgaagaaaacaacattgttccagcgattcatcggacattatttaccatcgacaacgtaaatgaagcgctaaaactagtcgcaaatggacgaccaaaagggaaagtgattattcaattttaaggggaatatgaagaaagcagtcaaaagttgagatcatttatgtaaatgtaaaggattttgaaacaaaccgagagttttgctgaattaagaaatggaaaagataaaaagccaggtcagatcatagaaaaacttcagcaagtcggagtcctgtatgataaaacatggagaactaaccatttcaaaaatgttggaatgaaaattgagacagatggttattttaaaagacatgccacaagtggcaagtggcatagccaatactgacaagcacgggtttattttcacgcttggctttgtcgaaggcttcttgcccccacgggtaccagtgaactgggttgtgagcgtgttgaaggaggtatggtgatttttccgtgatgaagtgggttgggtgtttggttgtttggcatgggtcacctgctttctaaatgttttttcgtattttcttttctccatttaatatatcagattgctgaggcacgtcataatttgtctgtgaggtattcccaaaatgaaaaaacaagggctataaacccttgatagattcattacttcatcttttaactacttcaatcgtaatgttttaacaagatggctgaattatgtcctccaaaaccaaaagaattggatagcccgtatttcaaaggaagctgtctcgcttctaatacaacgtctaagttgcaatctggatcttgcttctctacattaatagtgggtggaatcattcctcgtctcaaactttccactaaagcaatggcttctactccaccggcagcaccaaacatatgcccagtcattgacttgttcgctgttgttggaatttcacgggaacgttcaccaaataatgtcttaatagctagaacttctgaacgatcccctacttgtgtacttgttgcatgagcgctaataacatcgatttcatccgttgatatatttgcacttctcaatgcttttttcatggctaagtaggcacccttaccttctgggtgtgatgctaccatatggtgagcatctgaactagctccgtaccccacaacttcacatagtatcggcgcatctctaagaatagcgttttctaatgattctaatactaagatacctgcaccttcactcataacaaatccatctctatctgtatcgaatggacggctggctcgacttggatcttggtttctagtagatagtgcatgtgcgtttccaaaactagctaacgatatctgtgagacggcagcttctgctccaccggcaaatataatatctgcatcatcatttcggatcgcattgaaagcttcaccgatagaggtgttcccaatagaacaagcagtgactggtgacattgatggcccttgtgcccctaattttatgctgatttgggcagcagctgcatttgaaatcatcatgggtacaaggctggggcttactctcgaggggcctcgtttatctaatacattcacgttatcaacaagcgattggatgcccccgattcctgaaccaacatatacgcctaaacgttcaagatcaacatggtctaactgtaattttgaattttttaatgcttgttcggctgctgctaaggcaaactgactaaaacgatctaatcgttttgcttcttttctccccaatatttcatctgcatcgaaatcacgaacgattccagctatttttgttttataatcagtcgtatcaaaagaatcaatgagagatattcccgattgtcctttcactagttgattccaaaagctatctatatcatttcctagtggagaaataactcccattccagtaatgacaactcttttcatgatcattccctccttgttattattaactttagccattgtgttatcctattacaagttgttgtttatcctagtataattaataatattttaaagggagatcttcatgaaacctgaaacaagacttcaagcactatcagaatttctaaagaatcagcgttcaaaaatcacgcctcaaatggttggtttacctgtaggaacacgcagaagaacaccaggactcagaagagaagaagtggctcaactagccggtgtgagtcttacttggtatacatggttagaacaaggcagagatataaaagtatctacttcggtattggatgctatttctcgagcattacaattaaataacgatgaaagaagatatttgtacgctttagcgctagaggaaggtgtgaaacaatcctttatcattgaggatgagaaggaaatcagtccggctttagtgaaaatgttgcaggaacttcgttattgcccaacgattatttctgatagaagaagtcagattgtggggtggaatcaagcagcagctaatgtctttttggactttgaacagatcatcccggcagaaaggaatatcatacgcttactattcgcaagaaaggaatttaaaagtttagccgtgaattgggagcattttgttagaggatatatcgccatatttagaacgtattatggacagtatgtggctgatgactggtatgagcaatttatagaagaaatggagcaggcatatcctgagtttcgtaaaatatggaatgaaaatgagatcagctatgcgcctgaagtattaattgaatttcgtcatgctaaggtagggaaaatgttgtttaatctcacttcattacaagtgtatggggatactgatttaagatgcagtgtctatactccagttgaggatactgaaacggagctaaagttaaaacgtttaatcgaaggctagctattgtttggagtgtataattgatttgagggatacttcattaattttctatattttaaataaattaagtatttatggtagaaattatttcgtgctttttaaacttaatcatgacatttagcttctttgtgtatcgctgattgagacatgccgtctattcgcttatctcatacaaaataatgggaacggagagataaaatggattatgtttatcagaaaaaggagaagaaaaacggtaattgtgttatttccgttagagatagatgggagaattcaataattgaatttgaaaaaaagcaacatcatatcgatatagtggttaattaccgtaatgataagacaacgaagtattcaataccaatagagatttttgaaaaagtttacgatgatctgcaaagaggtaattgaggggatgtttgggttccttcaactacctccgcgttaaatgtatttcactttttttgatctttgcttaaccaatgtccttcagccataaacttcataacgcttctaaaaactttaataacacatcattttgaagttccatgtcgactatcctctacttcttcaccaacacatattgtaagttttctaattcaaacatatcaatcagttcatcgatccctttaaaattgatgtgttttccaaaccgttttttgcttaggtcaatttctacatccaattgatcacccttttctttcgtttcgagttcatttagacaagaatagatttcgatggtttctcctgttgacagctctttttcaatgaattgaaaaagtgcacgaagagaatgaatgatttctaattcataaacaaaaggatgcgtgaatttgtttcttaccgcttcatagaaaggatctagataatcaatgtgaatgccttcgaaatcctcttctgtttcaaatacttctatcaaaggatcttctttttgataggttttgtgctttttttgtattttatcaaacaattcgatattgagttcagagagtggtttataggtaggattttgaccaatggtaccaagcggcagttctttgcctgatccaatataatgctgtaaagtcatgggttgccctcttttcttcaatgatttcttattcgttgattatttactttttatcaataaatggtggaatgtgcaattcttttcacattcgttttctataaaagaaaagggcaagtcgtttgactaaatacctcttagggtatactatctgtcatagaaaggagtgcttaaattggaatataatcagcagatgaagaatcgtcttcgccggattgaagggcagattaaaggggttcttgcgatgatggagcaaggcaaggattgccgcgaggtggtcacgcagctgtctgcatcacgtaatgccattgatcgggcaatgggtgtgattgtgagtacaaaccttgagcaatgtgttcgtgaaagtcttgaacaaggcaaggatacggaaggtcttgtgaaagaggcagttgagctattggtgaaaagccggtaagaaattcctcagcctttggaggttgacggatttttttacttgatgtaatatacccttaccggtatatgtatatattttttattttctatatacccctataggtaattattgaaggaggagcaaaatggaagaacagaaaaaacgcacgacgatagtgttattcagtggagattatgataaagcgatggcagcttacattattgccaatggtgcagcagcttatgatcatgaggtgaccattttccatacgttttggggactgaatgccttgcgtaaggatgagatggtaccgatgaaaaaaggatttttagaaaaaatgttcggaaagatgatgccgcgcggggctgatcgcatggggatttccaagatgaattttgcgggaatggggccgaaaatgatcaagcatgtgattaaaaagcacaatgccatgaccttgccgcagctcattgagatggcgaaggagcaggatattaacctcgttgcatgtacaatgacgatggatcttttaggattacaggagaaagaattattggatgacattcaatatgctggtgtggcggcatatttagcagaggctgaaatcggacgtgtgaatttatttatctagtgaggtgaagcagggtgcagacgattttactcatcatcgtaattggattgctcgtgagccgctttctgccggtacgaggtgtgaagcaaatggatgcagctcatatgaaaaagaaggtgaaaagcaaaggtcaacagctcattgatgtgcgatcccccagtgaatttcaaacaaatcatatcaaaggctttcaaaacatcccgttgtctcatttgaagaaacgagcttctcagcttgagaaaaatgaagaggtctatgtgatatgtcaaagcggaatgagaagtatgcaagcagcgaaaatattgaagaagcagggatttactcagattacaaacatcaagggtggcatgaatgcttggcattaaatgcgcaataaaatatacccccatccctatttaaaggaggagaagacatgcagcaaccaactgtcattttagatgcaaaaggactggcatgcccgatgccgattgtaaaaacaaaaaaacaaatgaatgagctcttgccaggagacgtactggaagtgcaagccactgataaaggatcagcagcggatctagcggcatggtcaaaaagcgcaggccacgaatttttaggaacaaaagtagaaggccaggtgcttcatcatttgattcgtaagggcggagaacaagagaaagaagggaagtccatgatttcggaaatgtctttggagacttttcaacagaaagtaaaagaagatccatctttgtttattttagatgtacgagagctggatgaatacgaggcggggcatattccaggagctgttcatattcctcttggtgaggttgaacaacgtgcggaggaattgagccgggagacggacatttacctgatctgtcattcaggcagaagaagtgaattagctgcgcaaaagttaaaagaaaaaggatttcatcaattgatgaatatcgtaccaggcatgaatagctggacaggagcgattgaaaaataggagctgaatgaaacatgacggtaaaagcgatgactgcagaacagttaacaaaaaagatcgtgaacaaggagccgctctttttactagatgtgcgaaatcaagcggatgtgcaggattggaagatcgaaggggaagcaatcgttcatatgaatgtgccttattttgatctccttgaaggagtagagggtattttgcatgacattcctcatgatcgtgaagtgttggtggtttgtgccaaggaaggctcctctatcatggtcgcggagatgctgtcagaggcgggcagaacggtccattatttagaaggcggcatgaaggcgtggagtgagcatctggagccagtgaagattggtgatttaagcggcggtggagagctctatcaatttgtacggatgggcaagggatgcctgtcttatatgatcatgtcgaacggagaagccgcaattgtagatgcagctagaatgacagatgtttatatccgttttgctaaaaagcatgatgtctctatcaccgaagtgttggacactcatcttcatgcagatcatatttctggcgggaagaagctggctgaacagactggtgctagctactggctgccgccaaaagatgctgaagaagtgatctttgaatataaccatcttgaagaaggacagcgcataacgattggagcggcttccattgatattcatcctctttactcaccggggcatacaatcggttcaacatcttttatcgtggatgatcaatatcttctttcaggtgatattttgttcgtggattcgattggaagacctgaccttgcgggaatggcggaagactgggtaagtgatttgagggaaacactttatgagcgatatggagcactttcgaaagaattgattgtgttgccagcgcatttcatgattatggatgaaatcaatgaagacggaagcgtttggaaggagctaggcgttctatttgaagaaaatcatggactgaatatagaagatgaagccgtatttagagaaatggtcacgaagaatctacccgcacagccaaacgcttatcaagacattcgtcaaaccaatatggggaagctgagcccagacgaagaagcgcagcgtgaaatggaaattggtccaaaccgttgtgcgattcggtaatgtccaataaaataagaggagaggaacaatcaaatgacatcagatcaaatgttagacgtaacggggcttgcatgcccaatgccgattattcgaacgaagaaaaaaatgaatgacttgacggagggtcaagtattagaaatacatgcaacagataaaggggctaaagctgacttagcagcatgggtgaagtcaagcggacatgaattgatcacgcagacggaagaaggacatgtgctgaagttctgggtgagaaaagggtcctaaaggatgtaggggtatctgctgaagatccccttttccttttgcaaaggaggagaccagcgtggattttacgtttttgattacactttttatcatcggatgtattggttccttcttatcaggaatggtggggatcgggggatctgtgattaactatcctatgctactttatatccctccacttgtcggtgtgatggcactatcggcacacgaggtatcaggaattggcgccattcaagtgcttttttcgacgctcggtggggtattggcctatcgtaaaagcggatttttacatcggtcgttgattgtatatatggggagcagtatattggcgggcagcttactaggcagttatgtatctcactttatgccagagaatgggatgaatctcgtctatggattgctcgcgattgtggctgtgatcctcatgctgattccaaaaaagggacagcgtgcagatgcagagggagaagtcacttttcataaaggacttgcggcaggtatagcctttgtgattggcagtgtttccggtgtgctaggcgcgggcggagcatttatattggtaccggtgatgctgtctattttaaaaattcctgtccggatgacgattgcttcctcacttgcaattacgtttttatctgcgatcggtgcatcgactggaaaggtattgacgggtcaagttatgctttttcctgcggttgtgctgatgctggcaagtttaatcgccgctccgattggtgctaaggtcggtcagaaaattaatgccgtctacttacaatgggcacttgctgtgatgattacggcgacagcggtcaaaatttggcttgatttattataaagaaaagaccaacaaagcaaacgtgttggtcttttttatttgatgtcatcgtgctcaatatatgtttcaagggcagggtgatactctttttgataatgaaggttgggacatgttttcacgactttgccttgcagggcattggacttagagacttctaatgctgttttacatttagggcagcgttcggcaaaaagtgagggccagcgcttcatatatcaccactccatttaaagtcttaaaaaccgattatattaatatgaattataggggatcgtgctgatgaggtcaatgggtgtttgggtctttttaacaaaaaagaagcatcgtaaaggatgcttctctttcgtttcgattctcaataagcttttgcccaaaagaccatatcagatgcaggctttccgcagcagacacatgtgtctgaaacagattcctgttcaaatgggatacagcgtgaggtcgcccctgttctttctttgatgtcgttctcacaggcttcgtcaccacaccacatggctttaatcaatcggttttcttctgaaagaatgtgctcaatgtcttcgatcgtgtgagcttctgatgttttttcatgtaatcgttctttcgccttttcgtacattgtccgctggatgtcttcaagcgtggatgtgatggtttgttcaagtgcatctaatgcgacagcttgcttttcaccattgtctcgtcttgcgagcatcacctgacctttttcaatgtcctttggtcctacttcgacacgtaaagggatgccctgcatttcacattcgttgaacttccaccctggctgtttatcgcttgcatcgatgtcagcacgtgcgatgtgtgtgagtcgatctttcaattcgtaggcatgatcgagcacaccttccttgtgagaggcgattggcacgattcgcacttgggttggtgcaatgtttggcggaaggacgagtcctctgtcatcaccatgcaccatgatcatggcaccgatgattcttgtggtaaacccccaagaggtttgctggacatgctctagctttccttcacggtttaagaattcgatgccaaatgccttggcaaatccgttcccgaagaagtgagaagtggccgtttgcagcgcttttccatcatgcattaagctttcaaccgtataggtaaagcgggcaccagcgaatttttccttctctgtttttctccctttaatgacaggaatggcaaggagctcttcgcaaagagaagcgtagatgtgaagcattctttctgtctcctcaatcgcttcttgctctgtctcatgacatgtgtgtccttcctgccataggaattcaagcgttctaaggaatggacgtgtggtcttttcccagcggacgacattcgcccattgattataaagcttcggtagatcacggtaggaatgaatgatgtttttgtaatgctcagcgaacagtacttcagaggttggtctgacgcagagcctttcctgtaatttggattcaccgccatgtgtgacccacgccacttcaggagcgaagccttcgatatggtctttttcctgctgcagcaggctctctggaataaagagcggcatatacacattctcatgacctgtttctttgatttggcggtcaagttcgtcgcgaatattctcccaaattttaaagccgtatggctgaatgatcatactgcctctgacgcttgaataatcgacgagacgtgccttcgtgacaacatctgtataccactgggcaaagtcgtcttccatgcttgtgattttttcaacaaattgtttctttgacattgcatattcctccttttaaaaaacaaaaaagctgtgctttaagttagggaccattcctggtggtaccaccctaatttaaagcacagctttacactcgatcatgataacggtatgaaccgctgtatgaaacagaactaaatcggcaggttcacttgaagatgtcagtaggaacttctcagcaccgttccctctctgttaaaggtcaattcaagctactattccagatctacgttgatgaatgttcgttgatttttcatcagtttacctgtaaatgcaggagaaagcaagttgtactggttgttgttcagattgctttgtttgatcgtgaatttgcagtcatttcctatttttacagcttgccagttatgtaagcatatgctactatatttgaagaaaaaatagacttgtataacctcaataatatggtttgagggtttctaccaggatccgataaatcctgattacaaaagcgtgctttccttttttgtaatcagggtttttttgtttgtcttcaccctgtatcaaaagtgaaagcgatgatatagagaagggatgttagacatgaactggagagtatatttattagccgtttctacttttgcagtaggattagttgagcttgtggtcggaggcattttgccaagccttgcagaggatttgaatgtatcgcttgcgacagctgggcagcttatcaccgtatttgccattgtgtatgccatttcagcacctgtgctgctgactgccacagctaaaattgaacgaaagcgtctttatttaatcgcgttattggtgtttacgatagggaatgtcttcacatattttagttcgacctttgctcttgtcatgatctctagggtattgatcgcgatgagcacagcgctagtggtggtgttgtcactgacgatcactgctaaattggtggaaccagcgcatcgtgcgaaggcattagggctgatttttattgggattagttcttcacttgttctcggtgtaccgatcggtatttttattacagagagctttggctggagagtgatgtttttaggaatcagtattttatcagccatatcaatggtgctgatctatttcctattggagaaaatgcctgttgaaaaagtgacgcctcttagagagcaaatacgttctttagggcatccgaaaatttttagtgcacacttgattagtttgtttatgcttgcaggtcattatatgctttattcttatttcactccgtttttaatggaagtactgcatatgaccccgttctggattagtatttgttatttggtcttcgggcttgcttctattggcgggaatggatttggcggctggcttagtgacaagctgggttcagggaaagccattttgctcgtgacaatcgcgtttgcagttgtgatgtttatcattccttatacatcgggcgtgtttgtcctctttatgatcatggttgtcctttggggagcgcttagctgggcattaacgcctgccttgcagagttatttgattcaaacagatcctgtgacgtctgatattcagcaaagcttaaatacatcggcattgcaaattggtatctcaattggatcagcagttggcggtgtcctgtttacgatgaccggttcatctgttgatctggcgaaattcggtgcagtgtttgtgctgattgcctttagctgtgcggtgatttcgttgaaaagaccaccactttatatggatcgtcagcatcgtgctgaatagctgcctaatgataggcagcttcagcgtgtagacaaaccctcgcattcgttgtcagtcctgcgtgctggtgctcacgaatgtcaaattcgctccgcgccagtactcgtccttcctagacttcaaaggttttctatcacgctgaaaagaagacaaagggctaaaataaaaatcattttagccctttgtcaacaatctgtagctgcctcatgataggcagcttttttatgttctactttattctattcaaaaacaaccatttcgccgattggttggaagcctgcacgttggtaaatatttttgccgtcagctgatgcttgtaacaggacgcacttttgtttgttgtctgtctgggtcagaagataatgaaacatgtcactgccaagtccctttccgcggtgctctgcccttgtgatgacatcataaattccgtagctatcagttgcttcgagtaataagcctgttgtgaccggtttgtggtctgcatatccgacgaacatgcgaacgcgtgattgtatagtatcaagcgaaaaatgctggaaatagtcctctaaggcgatggcctccggtgactccttgaatagctcgataaagatatttttgtaatcaagcagtgtctgctcatcaactgcttctttgattgtaagcggtgaagatgtaactgggtcaatgtcttctgtctgctcaagcaacatgatcgtattgcgttcaacctctctaagctgatattcctttagtaaattggcccaatcaggatgaagcaaacgatgatccacccatgtactgaatgattgtttctgagactgcaagtgttcgatggccgttttcactttttgcggatctttgatgtgcgctgatgtcggtaatagcaaattgaatgtgtctgtcgatatatgagtattggatagaacgaagtcgtccgttgcgaggaaggttccgttcacagctgaagaaaacaggtgtatcttttcttctaattgtcgaatggcgatttgttgttcgattttcattagctcacctttttcatcaaaaattggatgacatcccccatgaattatagcaaataaaagaaagaggagctgtgacatcataggtcatctagtagaaaagtatatacaccattttcaggtctgatggcctgttctttttattacactgacatttcttttgactcctatcttaattattagtaccattttattaaccagttaagagtggaggttcagatggagacaaaagagcagattgttttaaaagcgattcaagatctgattattcatagggaaaagagaaggaatgacccaacagatccactgattaccacgactgatacactcaagcaagattggacactcacacagctacatattttatcaatgattcaagccaatccaaacgaatcaaataatacatttctttctcaacaactgaaactatcaaagcctgctattacaaaggctgtaaaaaaactaattgataaaggcatggtggactattgccaccggcaaggagataaaaaatctgtctactattcattgacagagaaaggtacgcaattggcggcgctgcatgatgaactgcatgagaaagctgtcgcgtcctacttagaatttctacagcagtttcatgaagatgaattacaagtcattgagcgctttttgaaggcatggaaagaaaaaatatagatttaaaaaaccgaaaccatcgtagaaaaggagatgatttcggttttttatatggtaaaattaacatatattggcgctattcgtgatcatgtggaaagggagggagcttctttggggaaagaaatgatggaaaattttaagaagtacgtatttatgatgccgttcgttggattgtttgtcagcttgctattatttgtttacttttttggcatcacaggagttgaaggatcaatttgggctgctactttatattgtgcccttccttttttggtgtacacgatattctgtttgccgttaagtatttattttaaagtcagtaaaaaacgctcaatccataaagaagaggaacaggcgtgattgtggtcagcgcttgtcttgctgggttgaaggttcggtataatggcagccatcgattagatcagcgaattgaagagcttgtgcaggaaggaaaggctgtgacagtttgtcctgaactgcttggcggcttctctacgcctagacctccggcagaaatcattggcggagatggatatgatgttttgcgggggcaggctgctgttgtcgatgttcatggaactgatgtcacagagatgtatgtaaaaggtgcaaaagccacactggagcggattcagtctctgaaagcaacagcggttgtgctaaaagagtacagcccttcatgcgggagccggatgatttaccaaggagagtttaatggtaagacaaaagcgggagatggtgtgacgtccgctttgttgaaacagcacgggattcaagtgttctctgaggaggatgattggatttcgttgtttctataggtgtttcgtggagagaaggaggagttaggttgaaaaagtgggtcattggtttagttgtagtagttttaataggaattggtatttattttatgatcaatgccaaaacgtactcattcgatgatgtggtctcgattgatcaacataaggtgacttcgattcaaattgagcatgatcataaacgtgttgttttggataaaaaagaagagattcaaaagctgttgaaggaactttcagatatgacattaaagaaaaccaatgaagacacaaaagcctcaaaagagtcttattggatcagggtgtatgagaataagaaggaaacatacggtctgactttctatgatcaggcatttctaacgacatataatttttctaaaaagaaagatcaaacaaacgaataccaaattgttgacgccaatcaagtcgatataggacaatatatcaaataacaccagcgaacattcatgcatgatcaatagaaaattcgggtatagtgcttggtaagcaaaaatgaagcggaggtttgtttgatgagtggattaacagatacagtcacattagcaaacggagtgaaaatgccgaagctaggcttcggtgtatggcaagtaaaagatggggatgaggctgtaaatgcagtcacagacgctcttgaagcgggctaccgcagcattgatacagcagcagcctatcaaaatgaagaaggagtaggcaaagccattcagcaatcaggtatctctcgcgatgatctgtttattacgacaaaggtgtggaatcgtgatcaaggctatgaatcaacacttgaagcctttgaaacaagtatgaacaagcttgggctagatgtattagacctttatttaattcattggccagttgaaggcaaatataaagaaacttggaaagcactagagaagctgtataaggatggacgcgttcgagccatcggtgtgtgtaacttccatcagcaccatctagatgatctattagaagaagcagaagttgtgccaatggtcaatcaaatcgagctgcatccaaaactgacgcaggagcctttacgagactactgcaaggagaaagggattcatgtagaagcatggtcaccattaggcagcgggaagcttctgaaccatcctgttcttcaggatattgcgaaaaaacatgacaaatccgtggctcaagtcattcttcgctgggacttacagcatggcattatcaccattccaaaatctgtgacgaagagccgaatcatcgaaaacacacaagtcttcgatttcgaactgtccgcacatgagatgggagtcatcgatcagcttaatgaggatgagcgcacaggtccagatccagataattttgatttttaatcgaaagaaaagcacaggtggcatgcctgtgcttttttatttaacgattttttgcggctgatacgttttcaatgacttgaatggcgtcgacaatttgctctatggaatagtctccaatcaagcaaaaggtttcgtctgaacgtgcagcatggcttgccactgtttttgcggcttcttccagctgagctgtgatgccaagctcacgcatatttctaggtaatccgagtgtttcataaagctcaagtaattcttctacttcgctcattcgattttctgcggcaagctgaacaagaatgccataggccactttttgaccatgtaacacgtgatgcgtttcttcaataaatgtcaatccgttatggatggcgtgggctcctgccattctgccgtagcgtcccccgtacccgccgaccgtgccggctaatgtaataatggtatccgttacatctgcaaatgcttgcgaaagctgacccgtttgcaagctgtggacagcttcttcactatgggaaacaagaatatctctcacatataccgcctgttttagcgctgcatgcaccatgagcggcaaggaattctttgcatttcgaataatggcttccgcttcataccatttggccagcgtgtctccaatcccactttgaaggtaggaaagaggagaagaaagcaaaaatgtatgatcaatgagggtgaggtagctggaccgtttatggtaatcgactgtcatgaaattccctttgtcatcataaatgacgctaagcggtgtagatgcagcacatgtccccgggatggttggaaccatgatcacttcaatttgaagagcctctgctactgacttggcggtgtctaaaatcgtgccgcctccgatcccaatgatcacatctgccccttgcagttcttctgcaattcgagtaattgcattgggtgaactgtatcctttgtgctggacaacaggccaatgagacggaagctttgtgtactgtgaaaaagcatgaaatgaatcatatcccgtcacgacagcgggcgactggaaggatggagaaacaagtgaatcgagttcatgataaatgcctttttgagaaataaattggtttggaccgcttctgacgatatcttctggctggatcattgcgttctactcctttacaacatcatatttcataaatcatctcattttacagaaagttctgtcaaatatgagaagaaagtcccttccgttttatggaattgagccgctgtcattgcctttaggtatgtatttcctgtatgataaagaacggtatgttttgattaaatttaagaggtgtttatatatatggaaaaacaatatcgcgttttactttactatcaatatgtccccatcgaggacccagaaacgtttacaacagagcatctagcattctgtaaggagcttggtttgttaggtcgtatccttatctcagcagaaggcataaacggaacggtttctggtaccattgagcaaacggacaagtacatgcaagcattaaaagaagatccgcgctttgcgtctatgccgatcaaaattgacgaagcagacggtcatgcgtttaaaaaaatgcacgtccgccatcggaatgaactagtgaatctgagccttgaagatgatgtgaacccgttagaattaacaggtaagcatcttagccctgttgaattttacgagcaaatgcaatcacctgataccgttgtgattgatgcacgtaatgattacgagtttgatgttggccactttagaggggcagttcgtcctgatattgagacattccgcgaattaccggaatggattcgtgacaataaagagattcttgaaggaaaaaaaatcctgacgtattgcactggcggcgtacgctgtgagaaattttcaggctggttaaagcgtgaaggctttgaagatgtctctcagcttgacggcggaatagtcacgtacggaaaagatccagaagttcaaggaaagctttgggatggtcaatgctacgtgtttgatactcgcttaacagtgcctgtgaatcaaacagagcatgtggttgtcggaaaagatttcttcactggtgagccttgcgagcgttatgtgaactgtgcgaaccctgcatgtaaccgcaaaatgattgcaacagaagaaagcgagcataaatatatgcgcagttgcagccatgaatgtcgtacgagtgaacgtaacctatatgtgaaacagcacaacctgtctgaagaagaagtgcaagaaagattagctgtgattgaacaagaacaagcaatctcacaaggatagagggtaccccctttatccttttttctgtacagaagaaagagggattcatttcctctttctttttttgttttgtttttttcaaaataagggtaaaggtagttattcagtctaatagattgaatcatcgaaaaagcgctttcttgagaaataagcatgttcgactatttcagaaaatggagaattgagagataataaaacaggcgaaaaaatgaacaagggtaaagatttagttgaagaaatatttgtcaattgaatgaaaagtgagctgcaatgtaagaaaggtgcttacttgggcacatgctttgtaatttaatcgaaaggtgttatgaacatgaatcatttgcatcgtagaatgggaactttcgctttaatgatggtaggtcttggctcaatcattggttcaggatggctattcggtgcttggcgtgctgctcaaattgccggacctgctgctattttatcctggttgattgggatggttgtgattttatttatcgctttgtcttatagtgaactcggatcgatgtttccagaggcaggcggaatggtgaaatatacgcaatattcacatggctcctttatcgggtttattgccgcttgggcaaactggatcgctattgtctccgtcattccggttgaggcggtggcttctgtccagtatatgagttcatggccttgggaatgggctaagtggacaagccatttggtcacaaaaggggtgttgacaacagaagggctcatggtcgccagtgtgcttcttgtgatttactttctgctcaattattggacagtagggttattttcaaaagcaaatacattcattaccgtgtttaaaattgtcattccaggattaaccattggcgcgctcttattcgtaggttttcatagtgagaattttacgtctggaacaagtattgctcctaacggctgggcgagtgtgctgacagctgttgcgacatcaggaattgtgtttgccttcaatggcttccaaagcccgattaatatggcgggggaggcgaaaaatccagggcgatcaattccgattgcgattgttggatccattttgattgcgactgtgatttatgtgtttttacaaatcgcttttatcggtgctgtcgatccgtccatgattgtgaatggatggggtcatttgaattttaactcaccatttgctgatcttgccattgcacttgggattaactggctggttctgattttatatgcagatgcgtttgtatcaccttctggtacaggaattacgtatacggcgacgacgtctcgcatgatttatggaatggaaaaaaacaaatacatgccaagtgtacttggtcgtctgcaccctatttatggcgtgcctcgtccagcgatgttttttaacttagccgtctcgtttatctttctgtttttatttagaggctggggtgtacttgcggaaatcatttctgttgcgacacttatttcttacctgacaggcccagtaacggtcatgacactgagaaagacagggacagatttatatcgtccccttcgaataaaaggactcagcatcattgcccctctcggttttgtctttgcgtcattgacgctgtattgggcgagatggccgttaacaggtcaggtgctattcattatcctcattggtcttccgatctatttttactatcaagcaaaagcgaagtggaaaggcttcggccgcaacttcaaggcgggtgcttggatggtcgtgtacttacttgtgatgatgacgatttcctgccttggcagtgacaaattcggcggttataacgtcattcattatggctgggatatggctcttattacagtggtttctttgctgttttatatgtgggcactcaaaagtggatttgaaacagaatttctagaggatgcgaaaaaaatcaatgatgagctgcgtacttcttcgcaagaagccgcatcttccaaagaataaaggaacggctgcctgaatatgacgggcagccattttattttgataaatgatgcatcacatgctgcctcagccaagtggtgacaccgcgtaaaacggctgctgtgacaaatgagatgagtacatacttcccaagctgattcataccttgtccactaagccaaaacacgattcctagaaaaacgagtgtgaatagaagcatgaaaagaaatgatgcagaccaaaaaaaagccttcactgaaggtcacctcctcggagtattgtatgcaggcaattgaaggatcagaccagctatgacggggtagaatgatggtgaaatctattgcaaaagtcagataaaaacaccaagtgatttgacagttatgttaagatgagagcatattttgagtgaagattgtggtttatagacggaggtgtttggggttgcagatacaaaaagttctaaacaataatgtcattagtgtgatagatgaacaaggaaaagaaattgtcgtcatggggagaggcattgcgttccagcggcggtccggggacccggttgacgaatcgttaatcgataaagtcttccgcctggaggatcactccgttcatgagcggatgaaaatgctgcttctggaggttccgtatgatgtggtcaaggtgaccgaagaaatgattcaatatgcacatacaaaactgaaccgaagattaaacgaaagtctgcatgtatcactcgcagaccatattcattacgccatcgaacgattgaagaaaaatcatctcattgagaattcgctcatttgggagattaaacggttatacaaagatgaatttcttgtggcaaaggactgccttgatatgattgaagagcgtcttcatattgaattgcctgaggatgaagcaggctttattgccatgcatatcattaatgcagagctcaatgaggacatgaatacaacggtcaatatcacaaaagaagtaaacgccattctcaccattgtgaaatatcatctcaatatggaatttgatgaagactcactcaacttttatcgttttctcacgcatttacgctttttcgtccagcgtctgattaacgaaacaatgcttgtcagtgaagatcaggacttgtatcagctgatcaaggtaaaatatccgaaggcatacgaatgtgcaaaaaaaatcgcagaatatgtctatcaaacctatcaccgagatcttacatcagaggagatgctgtacctatccattcatttgaatcgattgatcaaacgagaaaaataaaggtagtttttaaaagaaagcgttgacataataaaagctgagtggtactatttgctcataaacataaaagaatacggtttcacaatgatcgtcttagaggattgtgactgttcggcaggcaaaacctaaacgttcactgaaaaagcgcaacagcaagttgtgactatttttggtgcccgtttaggtttttattttgcccaaaaacgtatttttttgaaaaaaagggggtttttgtatgagttatcgtcaattagcagaagacattatcaaacacattggcacagagaaaaacgttcattcactggtccattgcgctacaagacttcgcttcacattaaatgaccgatcaaaagcagacaaagcagccattgaaaaattaaatggcgttgtgaccgttatggaaagcggcggtcaatttcaagtagtcattggtaatactgtaccagaggtttatcgagagattggggagtttacaaatctattagaggattccacttcttcatctgcaaaatcaggtggagagagcacgagccttttcggaaaatttgtcgacattgtctctggtatttttacaccacttctcggtgtcatggcaggtgctggtattttaaaaggtctattaggtatctgtatcaatgcgaaatggttatcacctgaagatacgtcgtatcaaattttatttgctgcgtctgacagcttgttctacttcctgccattactgcttgcattcacttcggcgaggaagtttaaagcgaatccatttgtcgctgtgacgattgctggtgcactcatttacccaaccattcaagaattgtcaaaaggcggcggagatgtgaccttcttcggtattccagtcgtcttaatgtcttatacatcaacggttattccaatcattttggcagtgtttgtcatgggatatatcgaacgtttctttaacaaagtcattcatgaaagtgtcaaaaactttattactccactgattttacttgtcacggttgttccgctgacactcattgtattcggaccatttggtgtgtatgcaggggacggcattgccgctgtcttgctgaaagtattctcctttagtcctacacttgcaggtgctttaattgcgatggcatggcaggttcttgtgatcttcggtatccactggggtctagtgccagtcattttaaataatattgctgtccatggaaaagatcatatcaagccggcgactgcgccagctgtattttcacaagccggtgcttccatcggtgttatgctgaaaacaaagaataaaaagctgaaatcattggctggatcgacagcagtttctgccgtgtttgggatcacagagccagctgtatacggggtcacacttcgtttgaaaaaaccatttattgcagccgttatctctgccggagtcggcggtgcgatcatcggttattcacaaagtattgcgattgcgtcaggacttccaagtttactgacacttccgattttctacggacaagggtttacagggttcatcatcggaatctcggtctcgtttgttctatccatcgtcttgacttatttgattggatttaaggatccagtagatgaagatgaaacgccagcaccggctgcggcaccaacaatggaaaacgaacatggggtcaaagcagctcatgtgaaaagtcctttaaagggtgaggtaatcaagctggaggaagtacaggataaggcattctcatctggtgcactaggaaagggcgcagccatcattccatcagaaggtaagctgtttgcaccagtatcaggagtcgtgacaacggtgttcccaacaggccatgcgtacggtcttacttctgaaagcggagcagaagtgctcattcacattggactcgataccgtacaattaggcggtcagcattttaccccgaaggtcgtacaggggcaagccatcactgagggcgaattgcttgcggagtttgatattgaagccatccaagcttccggcctgtccgtcacaacaccagtgattattaccaattcaggtgagtttagcgatatcatagaaacagaagaaaaacaaaccacaccaggacaatcatttttacatctcgtttaatgaagaggaggaagaaattatgagatattcaacactagcaccatttccaaaggactttttctggggcggatctacttccgcctatcaagtagaaggtgcgtggaacgaggatggcaaaggaccatctgtcattgatatgagagcaagttaccctgaagggacaacagattttaaagtggcaagcgatcactatcaccgctataaagaggatgtgaagatgtttgcagaaatgggtttgaaggcttatcgtttctctattgcatggacacggatcattccaaatggagatggggagatcaatcaaaaggggattgaattctatcattctctcatagatgaattgcgccgctatgatattgaaccaatcgtgacgatgtatcattttgatctgcctcatgcacttcaagtaaaaggcggttggtcaaatcgcgcgacagtagatgcgtttgaacggtatgcagaggttctatttcaggagtatggtcagaaggtgaaatattggctgaccattaatgaacaaaacatgatgatcttacatggatcagcgctcggtacacttgatccaaatttagaaaatccgaaaaaagaactgtatcagcaaaaccatcatatgctcgtcgctcaggcaaaagccatgacgctttgtcatcaaatgctgcctgaagcgaaaattggaccagcgccaaacattgcgctcatttatccggcttctccaaagcctgaggatgtacttgctgcggcgaattacaatgcgatccgcaactggctgtatcttgatatggctgtctacggccgttataacaaccttgcttgggcgtacatgaaagaaaaagacattcttcctgtcatcgaagagggagatatggatattttgaaaagtgcgaagccagacttcattgcctttaactactatacatctcaaacggttgaagcgagtaaaggagatggcaacgatgaatttgctcgcggaggagatcagcatttgaaatctggtgaagatggcgtatacaaaggcggcaataacccgttcttaagtaaaaatgcgtttggctgggagattgaccctgtcggcttccgatcaacgatgcgtgagatttatgaccgttatcagctgccccttattatcacggaaaacggattgggtgctttcgacaaattagaagaagatggatcgattcaagatgattatcgaattgactatttagaaaagcatatcgaacaaatcaaatgggcaatcacagacggtgttgaggtattcgggtactgcccgtggtcagccatcgacttaatcagtacacaccaaggctgctcaaaacgttacggttttatctacgtcaaccgtgatgaatttgacctgaaagacctgaagagaattcggaaaaagagctcttattggtatgaaacattgatcgagcaaaatggggagaacatcgggaagtaacaggaaaaagccagtcaccttattagcgggtggctggcttttttgttcgttcactttatcggcttgtgtcatttgtctaccacagaaattttcagcaaaatgaagttctaaaaaataaaaaaatgattgcggacaccgcagtcaaaaaagaaattatcttaaatccattgatacactcattttgatttgataacctttattttggaatttaatacaaaaggaggaatataaacaatatgttcaaaaaaacacttttaaccctaattaccctagctcttgtcatatcaatatggactccattttcatcagaagcatcagcagaaacacactctatcaattcacaagaattagaagcgttagtaacaccaacagttctacaaaatgaacaagctaccaaagaattagatgaacttgaaatgaaaatgggggaatacatagaaaatcttccatttacagaaaaagaattcgaaagcatgtcagagtcagaacaaaataaagtgatcgatcaatatttcaacaatgaagaatttttagctttagaaaaccgaatgaaacaacttgactccaaaagtagtcagagtgaaattacaacacaagcactaccagtattcttcatacctatcgcaatgaccgtaggaagagttgctttaatggctatcagatcaaaaggcgcaagaactgcacttaaatatctaaaaaatcggataaaaggatttggtaaaaattacaaaattaaatgggatgtaagaaatgataaaggacaacttagaagtttagttgtcgtcctacacaaaggaaagaaaagaacaacaagagtatttgctgtagacaatggaaaaatccctttaataccaaaaacctcaacttggtattggcatttccatgtagctccaaaagataaaatacaccatgctctcagagcatcagtaccaaagaaatacaaagcaagtccaggagaaacaatattacactaaaaaacccctaatttttaggggtttttttctcttcatgacttgtaactatatcaacaggatgtatcaagttttcatcatcattatcctcatcaatgtaaggcataataagtgaatccaactcttctttatcatcaactaaagcaacgtaagttgtataatcctctaaatctgatggaaacaattcagcttgaccaatattacttttcaatgcttggtcaatagcactctttaattctattaaaccctcacgattaccaataatataagaatccatgtgccaacttttttgagcatatatatgacaaatcttatctctatctttcatcatctcattacacccttcctgaaaaatttaattgattatgtgccaacacgcaaccagctataacatcaaacgtctcattggctactttatcctcattttcttcaatcctgataagatatccttcctagcatcaataaactatttccaaaactgtcaccaacatttttttgcccttttttccttctgctccgttgtcgcaattaattttttagtttcttgtttctcttatggcttctaatagctttttatctcttttaataagactgctttgtatgtattcttgctgttttttaactttctggaggttacaaatcccatcttactctctactatcattataccccgaattcaatctcatttatagactgttttccgcccagatcaggccgtatactgttatacgcaagtcaaaaacgataagggatgtggctgtatgaacgagaagcaacaagttttagatcttggcccattttttcatgggacgaaagcagaattgaagattggagatctgcttgaaccgcagtacttatcgaattatcaggatcaaaaatcaaaccatatctatttcaccggaacattaaacgcagccaaatggggtgctgaattagcaaggtctgatgcgaaagagagaatttatcttgtagaaccgttaggcgagtttgaacatgatccgaatttgactgacaaaaaatttccgggtaacccaacacgttcttatcggtcgaaatccccgttgaaaatcgtcgcagaattaggttcatgggaaagacattccgatgaagaaatcgatcatatgctgagctctttaaagaaattaagtgaagaaggaaaaaatgtcatatacgattgatgattctcaatcaacaaaggccgccttatcaacagctgggcggccttttgtttgatcttattgaaacaacgcatccatcagctcatcaaatgattttgattgattcagggagtgaatgcggtttggattgtccagtaaatcgacggcctgttcaaagaattgattcatgcaggctgcgtcatctttatgaatggctaataaaaagacaagtgatacttggtttccctgccagtcaattggctgttttaagtgtgcgatggctacgcaggatgtgccttcatttgtgatgagcgggtgcggcatggcaattccttttccaagataggtagacgacatttgctcccgctcaagcaccgaggaccgaaaagatgacgatactagctgatacgtttctaaacggctgcatagggtgtctaatacctcgtccttactggatagatcagcattcattaaggtcaatcgttcttgaaaaaacgccatcagttctttcggcggagtcctgtgtccatttaataaatgaataacctcattcacccgctgtacatcatgatgttcaaaaaaggcgctgacctgtatgactggttttccctttgaagcgagcgggacggttgtaatgatgacatcacagggcagggtggtgctcatgagataatcttggtaggaatacagctcgacgatgtccagttcgtgctgaaaggatgccttcaatttaatttcaagcagtcttgccgtccctaatccagacccgcacacgataatggctttctttttttgcgaggtattaagctgacttctttcaaatgaagcagcgatatgcagggcaacatatgccgcctcatcttcatttggcgttcgcaccagctgtaaggcattcagcccgctgacagccaaatcaaacgggtatggataggacgctttgatttcatgcagcagcggattttgtaaggatacgccatattggattcgatttaataatggcttcatatgaagcatcaggtcttgctgcaggatgttgtcatctgcaaatcgatgtccgctcattttctcaatgtgctgtagaaagacggtaaccgcctgctgaacttctactgtcgtctgatgctgggcggtttctttccacgtttgatttgccaatagatgcatgactaagtaatctgtttcatcctctgataaggtgacgtaaaaggtgtcactcacctgctgtataatttttttggcaattcgcattaagtcgggtgatcgttgtgtacgagtggtattcgccgatattcgctggttttttcgtgtctgctgaatcgcaatcgctaagtgaatgactaagttttttaaggcaatgtctttaatgagcaatgactcttgatgcagattcgtcaggacaatcgatcgaatggtttcaagagaaatatcgggaaaatggagctgctcccgctcggtgatatgagaaagtgcaggctcttcttcaaggagtaagtctgcatagcatgttcttttttgcaactcgtctccttcaatttttaagccaaacccaggctttgacacaagggtcataccgtaacgggctaacagctctcgccctttttttaaatcactgctgaccgtcatgcggctgataaacagttcttcagccagctggtcaatttttaagtaatccgcttgaagcaatagcttcctcatgataaatcgtacacgctcttctggcatgacggggacgagagagtgggcaggaagtttctgctgatgaagccagagcaggaaggcatcttggtcactcgttaatagggtgtatccctttccgcggatcgttttaatcttggctccagcttcctttaattgctcatttgcttctttgattaaatgacggatggagcggtctgataagtgaaaagaggcagtgagctcctccagcttcacgaaccccttcgtttcaaatagccgctgaatcagctgataggttcgaggatctgccgtcatcatcattgcgcagctccttgcgcctgtaaggcatcagtaccaagagcgatggcgcccattaaacctgataatccatcaaaggatggcttggtgataatttcatgtaaaggctttggcagctgtaaatacccatgaagccgcttttctgtttcctcaagaatgaggggcagcatagcgggctgtttcataacacctccaccgagaatgatgcgttctggcgaaagggtgagtaataaattggcggtcatctgcccgagatagtaggcatgaagtgaccaggcaggatgatcctctggcagcatgggtgccagtgtatgatagcgcccttctatggcaggtccggatgccagtccctctaaacaatcatgatgtatagggcagcatccaccgtaggaatcatgggggtgccgctgcactgtgatatgacccatttctggatgcagcaacccgtgaatgaggtggtgttcaatataggcaccgccgcctatcccagttccaacagtgatatagaccaaagaagcaggtttttctgcttcaaccgaaaagcgggcttccccgagtgctgcacagttcacatcggtatcaagcttcatcgggagcccaagggcttgttttaaggtagagaggaaagggaattggcgccaagctgttttgggtgtctctaaaatcgtcccataacttgggctgtgctcttttacatcgacaggcccgaatgccccaatgccaatggcatcgacaggatgctttgtaaagtaatcgatcacttgccggcatgtttcaattgggtttcctgttgcaaaggaagtcatgtgttcaatcgttccgtctgttgttccgtagccgcagacaaattttgttccgcctgcttcaatgcctccaattcgcatgatcaatgccctccgttaaagaggggcggaatccaaatggaccccgcccctacatgttcattttttctttacaatgtaggtttgtacctgacaaggtgtgagcggttcaatgtgtaatgatccatgttgtgctttgagtacatgtccttcaggtgtttcgcctaaattcgctgtttctccgtgttgtagagatgaactattgattgaagcggctgtttgacgcgttaaatatggattgaagagacggatgacaatgccagtcccatgctcttcttttttcagagcgcttagaatggctccgtctgtctcaatgtcaagcaggctataagtagattgtaagtcttctttttcatctcggaaagagaaaattaaacgaccgtttaaaaagtctgcccgttcgtagcattgaactggggtggtataccgcttggcaagctgcgctaagtgcccctcgctgacagcatccttgctatagtgcatgccaaatgaaaacgacagtgccccttgcagctgagcgtcaggtgtctcaacaattttttcgccagatgcgcgtcctggacggtaaagaagattttctttccccatttttccgaaacagcggaagagcgtatacgcgattgttgtgtagtcttctcctgtgatctggtattctctcacgcagtccgtcaacagcgcgacaccgtatgcttcatcacgaagtgcagtaaaggattgcatcggttcaatggtgatcggtttttcttcccaatgttcattgctccaccattcaagctcttgcgtgagctcagttgggcgttcgatggttccaaactgctgatcgctcaatgatacttttgatgcgatacctgtatcaaagaggacacgcagacgatggtctaacgcatgattgtcgacatcgacatgaaaacggatgacaggctcatctttgtttaatgccaccttcgctgtaatcgggagtgaagtcgtgactgcttgctgagagcgctcttctaagtcatatggaaccgtgagagtaagctggatggtgagctcttcttgcaagccgcttttagacactgtgatgtctgctgaagaaagatccttggatgacacatacagatcctcgcgcggcggggaatagttgtaggaatccccatcgtctccattgtcttcaaagatcatttgctcagagaatgtctggccagtttgtttatctgtgatgtccagcgatccattgttgtttgccgtaatgcggtaatacgtattttcaaccgcatgtccttcggtttgttcccatgcggattcgctcgattcaccgaaaaccatgctgacttgtgtataaccaacggatggtaagctggcggcttcgatcagtaaaacggctttccatacctgctttggcatgtacacttctttacttgggttaagagaaatttgctgtgccagcacataatctgtgacagcggttttgcttttcactgtgtactgaagtgttctcccatgtgcatcctttagtgtaaatggacgttcggtgataaaggtttcgacttcaatgacttcagaacgttttgaaggcaatgtattaaataacgtgagtgtgatgtcttgctccgtttgcagtcgaatcgcaatgagacgcatgtgcaggtccacaaggttctcggcgatttcctttgcctgcttgtagcggaagaagacgtcttgattcgtcgtatcactattacatccgccgatgctgtcatgcgctgcattttcaaacatgagataccaaatatcacgaaccgtgtcatgcggatagtcgtgcccgagtgaatagctgatcgtgaggataggctccattacattgacgagatagttttcaatttgattgtttaagatttttaaatcagcccgtgttgaaaaaatagatttgtgaatccgcatatgctttgcatggatgagctcaccttctaatgtttcaaaagatgtccgttcttttttcacagctgcgatgtaatcttctaaactgctgatttgatagtggtgctcgtcaagatcattggctttttctaataagtcaggcaggtttttgcggattggtgcctggtcaaagccatttgggaaatagacattctttgtggtggcctttgcttgcagcgcaccgattttttcagataaaaaggcttgtaagtcctcatccttttcaggaatatttccaccgtagtagtagccaaatggcaggttcaccgcaaagacttcactgccgtcagcaccttgccaattgaattcggtgtgattcgtcatatgatctgaaacgccgcgccaaaaagccgtatcgacaatgccaaatccgcggtaaatttgaggcatttgcgcggattgaccgaaggaatcaggaacatagccgactttcatcacatgaccgaactgctgacagcgttcaattccatattgcaggttccgtacaatggattcacctgaaatgacgagctgatcggtttgggtataccatggaccgatgatgagacgtttggctgtgacgagctttttgattcgattctcatcctcagggcgccatttcaagtaatcatccaataaggatgcttgggcatcgagcatgaaataatggaacctttcatctgtttcaagggtgtctaaaatgtccattacgcttttcattaagtagatacgggagcgggaggtggtgaaataccattcccggtcccagtgagtatgtggaatcacatgtacattgacagtcattgatcaacgacacctttctatgtgcaaattatccttctagtacaaggtcaaaatcgtcttcttctttctgcttctgatcatgctccggcgtttttggttcttttttctcagagaaattgacaagcaggttggcaccaataccgatgacgagtgcgccagtgagggctccgattaaataggcccaccagtttccgactgagaagaagccgtatagcccgccaattggcggcatgatgtcatgaacacctaataatgcagcaaccccgcttccagcagcacatgcgacaacattgagcggaatcaattttaatggattgacaagggtaaaaggaatcgccccttctgtaataccgataacgcccatgacaagaccgccacgtccagcttctctaaaggttggagagaagttgcgttttcgaatcagtgtcgcaagcccgtatccaagcggcggaatgacaatcgcaatattgacgagaatggcaggaaggtagacgcctgataggaagagcgcgttaccggccatccaagcagatttattcactggtcctccaaggtcaaagccaatcatcgcacctaaaatcagagcgagtgcgagtgtgcttgtcccgtcagcgaccatacctttgatccattcaattaaagccgtgttcaaagcgcctaatggcccgcccagcagaacggacatgagaagtccagttaagccaacggtaataagcggtaagatgagcagaggaacaagtccggctgcggagccttgaatttgaatttttcgttttacaaaaagagcgacatatcctgcgaagaagcctgcaataacggcaccgataaatccagcattcgttgagctggcaagggcaccgccgatgaagccggctgcaagccctgatttatccgcaatcgaataggcgataaatccagcgagcagaacgttcattaagccaatacctgtccagccaacctgctccattaaataggcgccgtgcagtatgccgccagcatctttataggcgtttaaatctgaaacaccaaaccctaatccgactagttttgctaaacccacgataagggaggcgccgatgatgacaggaagaatataagaaataccggtcatgagatggccttcaatgacttttaattttgctttcattttgctttgctcctttctatatggcattgctcacgtttattgagattcagattttttcttttcaacaagtgctacagcttttgtgatgatttgctcggcattttttaaggcgcgtccaatctcgacacgtactgtgggaatgcctgagaaacgttccgcatcgttgatatgctgattggaggcaatgatgcagaggtctgcctgctttgcttcctctgctgtaatgccatttacctgtcccataatcccttgctgctcgattttaatctcgtgaccgagctgtttacccgcattctctagcgcctttgctgccattggtgtatgagctaaccctgctggacatgaagtgacaccgacaattttcattgtgtaatcccctctttcaattgttgttcaatgacttcgtaataatagtcagcggcttgacctggttgtatcttttcgatgaaagccggttccatgaggcttgtcgcaatccctgacagtaatttcaggtgtgtgacatttgcttcttctaatggaacgagcagtgtaaataaatagcttgtgggcaaatcgtcaaagctgccccattcaatcggttgtgctagctctaaaaaaagaagtgaagccgattgtacagtggagctttttgtatgaggaatagcgaagccttgctgaagtcctgttgagacttcgtcttcgcgagtcaacaaatctgataatagccccgcctgatcgtttgtaatctgaaggtcttcagctttctcggcaatgtattgtaaaatctcattctttgatcgtccgtttacttgtgtgaaaacatgatctttttggaacaagctgatcccttctctcttgtttgttaagcgcttacaagttgattgtaatgtacttttcggcatggttaaatagcatcattttccgtttgaaatggcaaaaagtttatgaagctattcgtcttgcagtctgttatctcaaatcctagcttaaaacgagtttaattatgtaaaaaacagattctactaaatgcatttctgtgatattcttccaaggtgttacaaaagataagggggtcttttcatgttcaaaaagcaggtcaaatcctgtgtaatcgtactcatggccatcattctctgtatggcagcattacctggatacgaggcagcagctgccagtaaaggaacaaatgtcaatgaagccattgggttaaaaaatggtgaagtcatctcagggacattacagaatgaaatggaagagtcatggtaccaaatcacgccatctgcacaagaggtggcaaaagatacacatatgaaagttactgtcaaaagtaaacaagtgttatctgtatcggtctatccaagtaaagacagagcgatgaaggatgacacttattcgagatatcgtgtggacactgcaagtggagagacagagatcgacttcccgcatgcatgggcaggtccttattatgttaaagtgctctacttagggtcggaggaagacagccgtgatgaggaagaggatgcagcatatacaatcgggtataaaggagctaatctaccgccttctgaacccgttttccctgaagacgatgagcctgacatcattattatagagaaaaagtacgggcgcgaaattcttcagtcgattcgtacaattgaagataaacgttttaatgaaacaccaaatggtcagaagctgagccgtgtgcttcaaaaaacaaagccatttctcaaatcaaagctcatcaaacaaaaaaatgagcagcaaaaggtatacaatcatttgctgacattaaagtcactgctaaatgacgtagagaaaaatggtgcatatagcggtcatattgtgacagagaaagaacaacaggcgatccgttccctttttgatatgctcaaaggagcaagtcctgcctatttaaaaaaggaattagaagcagtgagtcaacagattggcatcaatcagcttgaaggaaagtcgatcggttatgtattagaaaagcaaaagcttgtaaaagaagagaaagtgaagacgaataaaatcatttttaaactaaaggatgggcaaacgcttcaatctgcgaaaaagaagatgaaaagctatggaatccaagaaaaacgtgtgacatcgcagtcagtaagtcctttgtttaaaggaatgtatgtctatgatgtgccagcagggcaagaatcagctggaaagactttaaaagcaggcaaagctgtgattaaaagcactgcgagaaagctgtccagcatgccgaatgttgaattcgcagagcctgttcaaacgtatcgtgcactgagcaatgatgtgcagtatggataccagtggccactgaaaaacagtgcgcaaaacagcgggaaaaaaggcgctgatgtgaagtttgaacaaatgaacacactgattggcacaagcaaaatgaagcaaacattgattgctgttgtggatacaggtgtagacagtcgtttaacggatctgagcgggactgttcgtacggacttaggtgcgaatctcattggacgaaacaaagatgccattgatgacaatggacacggtacgcatgtggctggcatcattgctgcaaaggccgataatcattactcgatggcaggtctcaaccaacatacgggcatcattccggtgaaggtgctggatgcctatggttttggagatacagagcatattgcacttggaatcaagcatgcagtggataaaggtgcaaaggtcatcaacatgagccttggcggctactacagccgcgtgattgaatatgcaatgaactacgcagctcaaagaaatgtactagtggtcgtggcgagtggaaatgatggcgttccagaaatgggttatcctgcgacatcaaagtacgcaatggctattggtgcaagcaaccgtatggatattgccgctgaattctcaagctatggtaaaggactgagcatgtctgcaccaggatctgatattccaagcttaatgccagatgggaatgtctcatatctgagcgggacatcaatggcgacaccatatgtggcagcagcagcaggattactgctttctaaaaatccagccttgaagccgaatcaagtaaggaatatcttgcaaagcacagccgataatatctcctttacatctgttgatggaacagatgacgttttctatgatgaaaatgaagagcctattgtcgatccaaaaattccagggatcgattggatgacaggacatggtagactgaatgcatttgctgctttaagtgctgtcgaactaaatgcatctgtcagcaaagtggaggatcagcatcaaaaggtgacaggtaaggcaaaggctggcgctgctatttctgtgtatagaggcaaaacactgcttggaaaaggcacagcgggcaaaaatggaacctttagcgtgaagatcaagcatcagaacaaaaacaaagtccttcacattaagatttcaaagggaaaggccgcaacgacgctcaaaacagtcgtcaaaaaaggcaaagcaccagctaagccgaaagtgggcaaagtaacggtcaaaagtaaaaagatcaaagggactgcgggcgcaggattgaccattaaagtaaaaaacaaatcaaagaaagtcatcaaaacggtaaaaacaaataacaagggcgcatttactgcccaaataaaaccgcaaaaagccaaaacagtcttgtatgtgaccgcttcagatgtgagaaaaagagaaagcaaagcggtgaaggttgttgttgtgaaaaagtaagaggagagcttccctttctaaaaaaagggaagtttttttgtttgttactggaaaaataccaattaatgtcgatagtgatatagtaggaaaaaaaaggaggatttatcgatgaaaaaaattatgtttgctttctttctatcattgcttctcgtattcccaacatttgcacatgctgaggaaaaaggagcagtaccagcatccgtacaagtaacaagtgttacagcagccgatagtggattagtgaattacggctatggcagtaaatatcgcgtgggctcttattatccagctacgtttaaaggaacactaaaagatacaagtggaaatcttatgcccaatcagccgatccagctttattttgaagcagcaattaaatcatatgctcaaacagcgacaggcacaacagacgagaatggacaattttcactgacgtttcaagttcctgcaggtgcaggctaccaaacatacaataatgcaggctggtctacacattactacgatatcgttccagtgacgttcacttcaaaagacatcaagctatcttcaaatgtcacaagtgtgtaccatttggcatatacagtacgtaactaatctgctgagggagacgacctggctgaagccttgtcgtttttttcatagaaaaaaggatgtcatcatgtgacatccttttctttttgttagcaaacctgctgggcggcaaccgaaagagtcgataaacaaacactcatgagccgtgactcccagattcgaacgagcgtttaacttttaattctgagctttgatggataagaactttcacacttgaacgttgatccttgaaccttcagctttgagcttttatcaaggatcatccagagatgatcagatgaggagggaatgacctttcccacggaggtgtttagttctatcgattttcggctcactaacaaaattgattaatcgatctgtattttcgttagtgtattgctctctgacaaggaaaaatcaacttccatttgaaaatcctcaatgtgggtcgaaagcttttcaatcttcactcgaagatgaagcggatcgatgattgtcgcctcattttcagcgaggaacgacttgacgatctcttggttggcagccgcttgtgtttttccgtctttcccaaacaaggtttctaaatgctggtcgagcctcttctttacctcttcattggtctgttctgctttgtctactagctctgtgtatacctttttcaatttccgtaaataacgaatatcatattctatcgatgtcttccgttcaatcgcttctgccactgtcatgctgacacccgctacatcaatcgttgttgtcgcattcgaaacaacgatggctgatttaatggcattccggcgtttgattaatgcttgaatcgattggtcatcagccttcgctttcttttcgatttcttcttgatgttgaaacccgtgctgtatatgtttcccgatcatcaatccaccaagtacggcttcatcaatggttcggttgattctcttatctaacattttcagttcgcttaatgctcttgtaatggtcatttccatattagtgacaactcccttggttcatcctgaaaatcatagaatcctatcatataccaaagtgtgcttcttttactagcaatatccttttttgtcagactgttatcatagaaaaaacctggcgttatacaccaggttcttcacgttttttctgaatccaagctgtcacataataggcagcatagcagagcgcgatgaagggaatgccgcagataagggcaatccgctgatttggatcaaaggcaatgccgatcacagaggcaagacacaggaagaaggcagcaatcggaaccactgggtagagaggggttcgaaaggtaagatcatggagctgtccgccttcctgtaaaaaacgtttccgaaacataaattgtgaggcagcaatccccatccacacgatcacaacggcaagtcctgagatcgaaacaaggacaaggtaaaccgtttctggtgcgatgacacttgataacaaagaaagaatcccgccgatcatacttaaaatcagtgcgttcaaagggattccttttgatgtcagcttcgccagtttcttaggcagtgtccgttcctcagaaagtgaccagagcatacgggatgacgcgtatagtccagagtttgcggcagataagatcgctgtcaaaatgacaaaattcatgaaatctgcggcatatggaatcccgatgcgatcaaacaccacaacaaatggacttttgatcaccccggcttcttccactgggatcaagccggctaagaccacgattgttccaacgaaaaacaagacaagccgcagtacggtagtgcgaatcgctcttggaatggtttcgtcaggattgacgctttcacccgcagcaatcccaattaactccgtacctgaaaaagcgaaattgacggccagcatcgtcattaaaatcggtaaaaagccgtttgggaaaagaccgccttccccggtgaagttagaaaggaacggagcggcctcaccgccctttaatggaatcaagccaaacatcgcagctccgccaaggataataaagagaataatagccattactttaatgctggaaaaccaaaactctgattctgcaaaaaacttaactgtaaacgcattgagtaaaaagatgagaagagcaaagacgccgctccacatccaaaccgatgtgtctgggaaccagcgctgcattaaaagccctgccgctgtaaattccgatccgagtgccactgtccatgtcagccagtacagccaagcaactgtgtagcctgtgccaggtccaatgtattttgttgcatacgtatgaaaggcccctgtaaccggcattgcgacagacagctcgcctaaacagagcatcacgaggtacacaattaatgccccgacaagataggcaaggatcgttcccgcgggtcctgcttgattgatggtatacccagagcttaaaaagagccctgttccaatgacgccgcctagagaaagcatgaacaggtggcggctcgtcatttttcgttgatattgttgtgattgatcttttgcttgttccatgtcttcccgcccttttgcttagaagtatgtgtgatgattcatgctgctatgatgtggtaagtcttaagatgtccgtgatatcttctggggtcgtccggcagcagccgccgatgatatgcgcgccgtcttgataccattgatgcgcacattcaccaaatgtatgctgaggcgtatctccgctccataccttttcttcgggatcatataactcccctgagtttggatacacgacaatcggcttgcttgtcccctttttcatctcttgaatgagagaagagataaattgcggcggcgtacagtttacaccaacagcagcgatctgttcataaggttctagtgcgtgtacacattctctgagcaaatcaccttcactgatatgaaggtcgtccctcgcactgaatgtaatccaagcagatacatcactgaattcatcttgcagcagctttgcaatggccgttgcttcaatgagacaagggatcgtttcacatgcaagaatatctgcaccagcttctactaatgcctgaatccttggtctatgaaaatcaatgagtgcctgctctgtaagcccgtaatttcctttatattctgaaccatcagataaataagcgccgaatggccccacagatcctgcaacaaatggttttgtccgccctttacgactggcttcatcctgccaaaaaaggtcccgtgcctcttttgctaaagtgacagatcgtttcattaggtcaatggcttcttcttttgaatagcctttttcagcgaagccatcaatcgtcgtttggtagctcgctgttgtggcacagtcagctccggcttggaagtaatccaaatgtacttgctgaatcaattctggctgttcaattagtattttggcggaccataaactgtcgtttaaattacagccctttcgttcaagctctgttgcaagtgcaccgtctaaaattaaaggtgcgtgagcctgtaagcggctttgaataggattcatggaatggaacaccctcctttttagtcggaaatgatggatatgatatgaggcagtagtttaaatgactaaagtgtttttgtcaaggagagggaaaagcatgtgatggctgaaaaaccctgaaaacatgcgggtttccatgcataaacatgcagtcaaaataatagaaaaccaagtcattgacagcctctaaaaagagatatatattatgaaaaggttcatatcagaaagcttcatcaaaaggcgctgtcttttgatttttattttgttcaacgactgtcttctttcgtgcagaaagagggttttttatatgcttaaaaaagggggaaagaagaaattgaaaaaatgtgtaaaagatatcgcaatgattctaattggttcgtttttatttgccgccgcagtgaacatgtttgtcattccgcttgaatttggtgaaggcggtgtaacggggctgtccattattttttattatttgtttgaaattgcaccatggctgacgaacctagtgtttaatgccatcctgctgcttgtggggtataaatatttagacaagaagacgacgatttatactgtggttgccgtcgcaagtaactccctattcttacacctgaccacaacatgggtcgtgaatgttcacgaattgatcattggcgccattttcgcaggaatcattatcggaattgggattggtcttgtgctaagagcaggcggtactacggcgggttctgccatactcggaagaattgccaacaagtatttagactggaacgtgagctacgccatcttgttctttgatctgatcgtcgtatttgcttcctactttattattggtgcggaaaaattaatgttcacgattgtgatgctgtacgtggcaacaaaggtgatggacttcgtgatagaaggacttaacacgaaaaaggcagtgacgatcatttcttcatgcaaagatgatattgccgaagaaatcaatcacaccttggatcgaggcgtgacgattttaaacggacgcggtcattattcaaaggaatcaaaggaaattctttatgcagtcattcaaaaacaagagcttatgcgtctaaagaaaatcattaagaaaattgatcgagacgcattcgttgttgtccatgacgtgcgtgatgtgttcggagaaggatttgtgaatatataaaaacggaaagaccccaaaagggtcttttttttattttatgctttatacctcttgtcacatgatactatgtaatgtatagtataaatggttaggagttgtaattatgaatgcacaattaaaaaagggtttacttgaattctgtgtactggcggtattaaagaaaggcgattcctatggttatcaaatgattaaagatatgtcccattgtattgagatttcagaatcgacattatatccgatattaaagcggttagagcaaaacaattatgtggagacctattcccaggaacataatagtcgattaagaaaatactaccggatgacacaaagcggccgtgagcatatggcgcagtttttagcggaatgggatcaagtgatggcgatttacgactttatttctggaggacagggcaatgaataaaaaagaatttttagctagcttagagaagcacctgcatcgtctaggcgaaaaagaaagtgatcggttcatcgagtattacgatgaaatgatcgaggattatcaggaagatggctacagtgaacaggaagcggtcgatcaagtcgggcagcctgccatcatcgctgaagggattttgaaggaacaaggaattaaaaccgttcaggtgccgacgtttggagaaaaagctacaaggctttccatcctcattttaggttttccattatggggtagtattctagccacagttttcctgctaattctttctatgtatatggtaatttggtgcattccactcgtgacaggtacaatgacgctagttggtctgctcggcggtttttggagcatcattggttctccgtttatctttcaggacggtttgcatgtggtggtgacgcagattggcgttggtatttttctattaggtgtcggattattatgcggcatggctacggtgtatttgacaaagctatttgttcaaatgacttttcaaaccactaaggcattcatgggaatgtttaaaaagaaggttgtgagagtatgaacgtgaatgatttaaaaaaacaatgcatcaaatgggggatcatctttaccgttgccggaggaattgtcatggcaattggtttaggactatcaggctttgacctagatgcatatgacaacaatgaccagaacaatgtgttccgcaccatcaattggagcaagccataaatgaaagacccgcttatgcgggtcttagcgtgtagacaaaccctcgcattcggtgtcagtcctgcgcgtcggtactcacgaatgtcaaattcgctccgttccggtgctcgtccttcctagactgcaaaggttttctatcacgctgaaaagaagacaaagggctaaaataaacatcattttagccctttgtcaacaatctgagacccgcttatgcgggtctttttttcgctcgaaccacaaagaagaaataacagcaaagtgcacctagttcacaaagcataatgatcaggcccattggaaaggctgtttggcttccggctagtccgacaagaggcgtcatgcaggcgcctagcagcatttgtgccacaccgatgagtgcggctgcacttcctgcatgtgcgccgtgatgctgcatcgcaagagacggggcagaggtgccgacaattccaacgcttgataccacaaaaaagagcggaatgagaataccatacaatcctgcatcaatggagatcatcaaaaataaggtgacgccgcctaaggcagctgtcagcaatccaatgcgaagaaccttctcttcgccgattctcgcagcgacacgggcaaatacttgtccagctgtgatgattccaagactattcaccgcaaaggcagcactgaatccttgtggagaaaggtgaaaaagctcctgaagcacaaacggtgagccagaaatataagcaaacatcgctgcgaatacaagaccttgcgagagggcatatcctacaaagagacgatcactcgctaaaattttcatggcgccaacaatctgttgaaagcctcctgtttgtctgcgctccgcaggtaaactttcctgaagtgaaaaaatagatctcagcagcatcaaagccccgagaattcctaatagaacaaatacaccctgccatgtggtaaagcgtaacatctgtccgcccacaataggtgccgctgccggagcaaccccgttgaccaacatgagcagtgcaaagaatttcgtcatttctgagccttcataatgatctcgcacaatggctcgtgcaatgacaatgcctgctgaaccagcgagtccttgaatcaatcttaagaggatgaacatccaaatcgacgagaccaccgtgcataaaagagaggcggcgataaaaatgattaagccgatcatcagcggttttcttctaccgatcgtatcactaataggccctgcaatcagttgtccaagtgccagtccaataagacaagccatcagacttaattgggacaaagcagtgcttgcttcaaaatctcgcgcaatatgaggcaatgcaggtaaatacatatccattgcaagcggtgcaagggcggttaaagaaccaagcaatgcggcaaggagaaatcggttttttttcgattcttggggataagataaagaactcatatgatcattacactcctcgtatacttcctcaaaacagcataatgaatcaagcgttctttttcaatggaaattttcaaagaggattgcgtgcaaaatgattgatctttcgaatgagactctttacattgaatgagtagagaaaaggacaaggtcaacgacatgcagtatttgcaagatacgtatatctagcattaaacaacaggaggtgctgacatggagcagcaagagctgatcattcgtcaagcagtcaaagaagatcatgaagcgatcagacatgtactaatcaaatcctattcacagtatgagcctcaatttacggaggaaggctggcaaaattattctgctgcgcttgcagcagctgtagataatccaaacatggagctgatgcttgtggcggagcttgaaggcaaggtcgtggggacgcttcaaatgttccggtcatcagagcaagcgtatgacaaacccgaaatgggcattacatcagccatcgtccggtttttaggagtagatcccgatgtcaggggaaaaggaattgcagagtcattgttacgtaaaagtattgaactcacgcaatcatggggcgaaaatgttctgtaccttcatacatctgataaaatgcaggctgccattcgtctttatgaaagaatgggctttgagcgtgcactagataaagaatttgtgaatcaaaatgggacgcatgtcaagagctatcaatatgtcatccagaaagaacagccggcaggttcatcacatcacgcgtaataaaaggaagagcatgtcctctatggacagctcttcctttttcaatttacgcccacagtataagcgcccaataggatactccccacgagattaagccgaacataacaaagaattttaacatgcgctcataaggagaaagctttcgttctctcttcgttttcaccagccgccaaaaatgaggatgatttgtccaagctgtgtaaggttttcaagaatcgtgattccgttcatttatttcacctcatcataggtcttccatatgtgaatgcagcaagcctttattttttcataaaaaaacggtgtatactggaaagagagaaactagatgcaagagggagttgtgacatgttgttttcgctacatgcggatcggtgggatgaagtaattgagagaaaaatcaaatacgatcagaaggttgtggaacatacgtgtcagctgttagatgcacagggacagaaaatggtgctttttcacaagattgaagagacgttttcgatgagtgcaggcgatgatacgctgacgattccaaaagggagctatacgaccgcctactattggaaggatcgtccttacaatatgtatttctggagagatgatcaagggaaggaactaggttcttattttaatattgtggggaatacatggttgaacggccagctggtcatgtttgaagacctcattgttgatcttctcgttctaccgaatggtgatttttttgtattggatgaagatgagttgccagagagtttagcggattttgaacaaggttcagtgcgccgagcattagagggtgtgatggcttcgttagaaagcatacttgatcaagtgagggcagatactgaaggaaaatatcatcatagcttattttcaccgctgttaaaatagaaaaaaacgattcctttcagcgaggaatcgttttttctgttaaaccttgatacggtttaatcgtttttgtaaactggttttcgttttagaagcttttagctgtttgacagcggtttgcgctgctgcttttgttttcttcgttcgttttgattccgcttttttcaccttttgtttggcgtctgtcactttcttttgataggcaacctgttttttgactttgtcgagccggttttgcaggcttgttttttctttgcctttgtttagctttttgatggctgtttgagcgcttttcatggcgccttgtgttttgcttttttcggctgtttgaaccttagcacgtgccaagcggatatcaatggttccttgtacctttttcacccgttcagtgagtgctgttttttgtttacttgcagtgagtcggccaattcttgttttggcttgattgacatctgcctgctttttagaagtttcggctgttttaacagcgctggtcgcagcttttacaaaggtggactgcggtatatattgcacgcggccatacccgaattgtggatcttttccttttgtgccaagatccactgtatagctgcgcaataaggtgcgaagctgcacatttgttttcttcggatgaagctgtttcaacagtgccagcatgcctgtgacatgcggcgtagcttgtgatgtacctgttgcataccaatattcattttttaaataagtgctgatgacgttctggccaggggcagaaaattcaatgcctttccctgtatttgagatagacgcgagtttgtctttgtctgtcgttgcagaaacggcaatgacactattgtaagcggcagggtaactaatatgattcttcttcccatcattcccgcttgcagcgaccacaagcagaccttttttatatgcttcatccactgctgagcgcaaaatagggatattgtcttcaaaacctaaacttaaattcataatatccatcttgttgctaatggcccaatcgattcctcgaagtagactgtacaagtcgccttctccctttttatctaacactttcacagcatacagcttcgcgccagaagcgacgccgactgtgccgtaatcgttattgagggcaccaatcgttcctgcgacatgtgtgccgtgtccttcatcatctttataggaggaagtgtagttcacgaatgatttaccgccggatatctttaaatcctcatgtggagaaataccagtatctaaaatggcgactttcacatttttccccgtgacgccttcttttatcgcttgctttacattcagcttttgcaggttgtaagatttttgaaccaatgcatcctgattcgtagaggcagcggtttttttcatcgtagaagaagcgagtttgacctttatgttttttgaaacgtacgcgatgttggggtcttttttgagtgacgtgaccgcttgttcatctgctgtcacagcgacagcgggaagatgtatgtactgttcgttcactttttcactttcttcaatcgctgtttgctttcctttttggtttttatagacgatgatgacatctgtttctttttgcggtgcagctgcctgcgaatggtaaggcaaggcagttgtcaacgcaagaagaaacgcgatgactacgacaattttctttttcaaggcgatagccccttgcatacgatgacctccgtctttttttctctattatatcggagaaatgagagggatggttagaagaatcatattgtttgtcagaaagtttttttacaagtaacctgaaattgaaattcatacaaatctagtagacaatagaaatatcataataagagaaagtaggatatgctgatgaacgtaaaagagtatatgacgtatgatgcgacaggcttggcagcacttgtacggaataagcaggtaacgccagacgagcttgtacaagctgcatttgctagattgaatgaggtcaatcctgaactaaatgcgttgattcagacaagacaagatcaagtattaaaagaaatcaagacattacatacgaatcagccgtttgcaggcgttccatttgtactgaaaaatatatcgcaagggctggaaaatgaaccgctgacagcaggtgctgcattgttaaaggatgtaaaggcaaaaacggactcccactttgtccagcgattgaagcaggctggatttctcatgatggggcatacaaacacaccagaattcggattaagaaatgtaacagaacctgctttacatggtccaacgaggaacccttggcatcctgactattcccctggcggttcaagcggcgggacggcagcagctgttgcaatcggcatcgtgcctgctggaggagcaagtgatggtggagggtcgattcggattccagcatcctttacaggtttgtttggtctcaagccaacaagaggaagaacgccggtaggaccaggcgcaggaaggcagtggcaaggggcatccattgactttacactcacaaaaacagtgcgggacagtgcagcccttcttgatctgcttcaagtcattcagcctgaagcggctttccaaacgccgttatacgacggcagctatcaagaagatctagtgaaacgtacatcttctatgcgaattgcttacagtgtacaatctccagttggtacgaaggtcagtgaggaagcgaagcaggcggtgcagcaaacagtgaaatggctgagtgaacaagggcaccaagtagaagaagcagggcctgcaatcgatggggttcatctgatgcagcaatactacgtcatgaacagcggagaaatgtctgcattattcacgtccttggctcgttcattaggacgtccagtcaatccggaggaaacagacatcgtggcatgggtgttggcggaggctggcaagaacgtaaccgctgctgcttacacagaaagtcttgatgcatgggatatggcggctgcacaaatggcgtcatttcatcaaacttatgatctctttgtgacaccagcgacagcctattcagcccctaaggttggtgagttgatgcattcgaaggaagaaatcactgaacttttacgtgtgtcatctctctcaatgcaagcgcagcaggatctcatttatgacatgttcttaaagagtttgacctacacaccatttacacagcttgccaacttaacgggtcagccttctatgagcgttcctgttcatctcactgaggagggcatgcctttaggtgtccaggttacagcacctaaggggaaagaggattggctgcttcggcttgcagcagaaatggagacatcctcgatttggaaaggaacaaatcaactcatatgttgaaacgacatttgtctatggagggaaaggagtgtcacacgtgagtacgaaggatagaattattcaaacggccgcacttcttttacgcaaacaggggtatcatgcgacaggattgaatcaaatcattagagagagcggcacgcctaaaggatctctttattattattttccaaacggaaaagaagagctagccatagcagccgttgaatatattagtcaaaaggtcatcaatcaaatagaagaaagctttgcctattcgaacgatccttatattgccatcgaccgttttatgacaaacatcatccggggatttacggagcaggaaaatgaaagagggattccgattgtcttgctggcggcagaatccaagccagaacatacgcagcttcatactgcatgtaaacaagaaatgatccgctggcaaaagcttgtgaaagaaaagctcatgaacagtggttatgaagaaaacaaagcggatgagctggcttccctccttcattcaatggtgattgggggtctatcgatgaccacagcactcaaacaaacgaccccgttagaacatgtgaaatgttaccttagacacttatttatgcgagaagagtaaaatctctcgcatattgtctatctattatatcaattggtctatataataaagatagtcaattcgtcatgaggagtgatgggatgtcggagcaaccgcaatcgatcaagcaatccgaaggtacctctttttataccttgtctggttcagggaagctgtatgggctggaaaatcagcttgttcatgtgctggcagaagcaactcgaacgaatcagctgtttgagcttgtcttaatcacaggtgggaaaggagcttattttccacttcactgtcatgagcacttatttgaaaccatttttgtgctggaaggaaagcttgaagtgattttggatggtaaaaaatatatggtcacagccttcgattatattcatattccgcccaaaacgatccatggctacagaatgcatagtcacaaaacaagatttatttcatatacgttgggcggacaaatgacagatgtctatcagcaaatcgggaaaaagcttcagctgaacgaatggccaatgactgatcatgctttcgatgcagccagctttgaacaagctgaaaaagaaagcgatctcattttgatgcatggtatacggcagctgtcaaatacaacaaagccctccgttttatttcatagtcagcttcctcaggcggtgcagccctatgtattagaggctggtgaagggaagcaatatatcgtggatggtcagctccatgagctgatcgcaacaacagaaacaactggaggcgggttcagtcattttgtgattgaaggcgcgaagggaaagtattttcctccgcattatcatcaagtacatacagaagcactctattgtgttgagggaaaaatgaatcttcaattgaacggtgaggatatatgcctgatgccgggtgactttgcctatataccgccggatacaattcactcttatgaattcgtgtctcattctaataaatttttgctattgctgctccctggaaagattgagcagttgtatgagcagtttgaagaatcacaaagtccgagtatatgtccttattttattcaagaagggaacttgatgatcgatcgagagacttcctctcaatatgatttggtctttatcgataaaggataaagatgtaacgcgttacacacatgattgaataagcgcctgtcgaaccgatcgacaggcttttttgttttttcatattcatgatttgatgcatgaaccatcctctcaaggtgaagctatgtacagatgattttcgctaaaggaggaaatgcatgtgagagctgttacttaccaagggaaaaatagcatcgcagtgaagaaagtagatgcaccatcaattcaagatcgggaagatgtgattattcgaattacatcaacagcaatttgtggatctgatttacatttgtatcaggggaatttcccgcttccaatcggttatgtgattgggcatgagccaatggggattgtggaggaagttggcccagatgtcacggcagtaaaaaagggagaccgtgtcgttattccatttaccgttgcatgtggtcaatgccaatattgccatcaccacttagaaagccaatgcgacaactcaaacccgcactacgattcgggtggactttttggatatagtgagaaatatgggaactacccaggaggacaggcagagtatttacgcgtgccttttggcaattacaccccgtttaagatccctgatgattgtgagctggaggatgaacaattgctgttcttatctgatgttctcccaactgcttattggagtgtggagcacgccggtgtgaaaaaaggtgatacggtcattgtgttaggctgtggacctgttgggctaatggcgcagcaatttgcatggcaaaaaggggcagaacgtgtgattgcggtcgattacattgattaccgtctgcgacatgcaaaacggatgagcgtcgtagaagtatttgattttacagaagatcccgacatgggagaaacgttaaaggagctgaccaagggtggtgccgatgttgtgatcgattgtgtgggaatggacgggaagaagtcgccgcttgaaaaaattgagcagaaactcaagctgcaaggtggaacgatcggaccgattcaaattgccacaaaagccgtccgtaaatgtggaacggtgcagatgacgggtgtgtacggcggtctatacaatatgttcccgttaggtgcctttttcgcaagaaacgtcacccttaaaatgggtcaggctccggctagaggctacatgtcaaagctctatcaaaaagtgacaactggtgaaattgatcctagggcgatcatcacacatcaattgccgttagatgatgccgctcatgcgtatcacatatttaatgataagaaggatgattgtataaaggtcatcttaaagccgtaaagaagaaggcttaggaatgttcctaagcctttaatgtgtgttcgtccatcattttctcaattaattcaaaaaatgtttttttatcttcttctgaaagatggttgaacagttgattaacaagcaattggcggttgtcgatcatttgttttgcaatttgttcaccagattcagagagttcaatccatacagtacggcggtcattattatttcgagagcggataatcagcccttcatcttctaagtgattgagagcggttgttgttgcagagggagataatgaaacttcctgcagaatatttttcacagtacatgattgatgacgataaatgatgcgtaaaataaaccctttcacattcgtgacgtttttcgggatgttctcttcatctatttgtttcgtcgcctttaaatactttgtcagcgcatggtctaataaacttgcctctagctcgaaatgttgcattctccatacctcttttcctattgcattcgcattttccgatcaattactaggtctatcttatcataatagttatcatcatttaaaccaaaatggaagacggctataaaattacctatattatcaattaatataaagaacaattccaaactgaaatgattttactttcagctggttttattttagaatgtgaatgagataaaatctgccaacccattcactggaaattggctattgtaaatcaaacgtttggagatgaagatattgaatacactacaggcattacttaacgacagaatggaacgctcatcacaaattgaagcggtaactggcgggggtgtgtcttatacatttgaagaatatgcaaagcgcattgaccagctcgctcattacttacaccaaaaggggattcgaaaaggggaccgtgtttgctttattagtcaaaaccatcatcacttccctacgattatgctggcagtcatcaaagcaggtgcagtcgcagttccgcttagctggcagcttacttcctttgagctagaaggtattttgaaaaaagcagagccaaaggctttattttttgatcgtgaattccgtgacatcattgcggcagtgaatgtgtctttagaagattgcctgatggtggaatcaggtgtcaatgcgaaaacaacacagctgtttgaagacattttggcttcaaatgatggaagtaaccttgctgaagaggtatcagaagaggatctagcgatgattttattcacctctgggacaacgggcaatccaaagggctgtatggtcggacatggacgaatctatcaatttttaacaagacgtgggaatcgaggattcgatctgaaaggaaaacgatacttggcgagtcatcctctgtatcatatgagttcaattaatcatctgatcgcagctgcaattgaaggatatacacttgtcttcttacatgatgcaacaccgaagcgcattttagaaacgattgagaaagaaagaattacgttcatgatggcttttccatcagcttacacgtacatgctagaagaaatgaaacatggctcgtacgatctttcatcttttgaaattgcgatttctggcggtacgaaggtgccggtgcgcttaattaaagattacaaagaagtaggcattcagatgatgcatggctatggaagtacggaagcatgggttgtgagtgcgtggcatccagcgatgggcgaggataaaatgggctctgcgggtaaagtggacccagatgtagaagtgaaaatcgtgcatcctgagacagacgagacattgccagctggagaaatcggcgaagtcgtcatgagaagcccattttatttcttaggctactatcatcagcctgacgctacagagaaggtactcaaagatggctggttccatatgggagatgcaggctatctagatgaagatggttttcttttcatcacaggcagatacaaagatgtgattctgtacggcggggataatatctatcctgaccaagtagaagaagtcattgatcaaattccaggtgtgattgaatcagctgtcattggggtaccggacgaattatatggtgaagtgccaagtgcgtatatcgtaaaagacgattccgtcgatttttgtgaagaagatgtggtgaactattgccaggaacgtttggcagattacaaagtaccctccattcatttcacacaggagctaccaaaaaataagcttggtaaaatcatgaagaaggatttacgtgaattggttgtgaatgcgtagtacctattctgctataatgaaatttgaatgattttttgtttttctaacgttttggagggaaagggtttgcgacatattcttcgtaagaaacacattcacgatttgttagagcagagcaggcagcaaaaggtacagaaaacgctgggcgggctcgatctcacgctccttggtataggggcagtgatcggcacgggggtcatggtgttaaccggaattacagcggctaaggatgcagggccggctgtcattttttcctttgccattgcagcgattgtgtgcagtttggcagcactttgctatgcagaaatggcttcagcgctgcctgttttcggcagtgcgtacatttattcatatacaacgatgggtgagcttgtcggtcatctaatgggatggacgttattgtccgtgtatatgctgactgcttcagctgtcgccagtggctggtcgagctatttcaacagcttgctcgaggggtttggaatttcgattccccatcaattcttagcggggccggaacaaggcggatatatgaatctgccagccattatcattgccttactaattgcgtggatcttatctagaggaacgaaggaaagtaaaaaattcaataatatcatggtgtttgtgaagctcggtattattgttcttttcattgtagtaggcgggttttatgtacagccagccaattggcagccattcatgccgtttggtgcagaaggtgtcattgccggtgctgctgctgtgttttttgccttcttaggatttgatgcgatttctgcttctgcggaagaggtgaaaaatccgcagcggaacctgccaattggcattattggctcattactcatttgcacgatcatttacattgtcgtttgtttgattatgacaggtatggtgcactatacaaaactgaatgtcacagaggctatgtcctatgtgctgcaaagtgtacatcaaaatagcgtggccggtattatttctgtcggtgcggtcattggattgatggctgtgattttcgccaataattatgcagcaactcgaattgcgtatgcgatgggacgagacggtcttttgcctaaaatgttttcgaaaacaaacaaaagcgatacgcctgttgcaagcatatggatgattggcggcatgacagctgttatttcagggtttattgatttaaaggacttgtccaatttagcgaatatcggtgctttattgacgtttgcgatggtgagtttatctgtgcttattttgagaaagacacatcagcagcttgagaggggattccgggttccatttgtgccggtattaccgattatctcaatgggctgttgcttgttccttatgctcaacttaccaggacggacgtggctttactttggtgtttggctgttaatcggtgtcgtcatgtacgcagcgtattcaaacaaacatagtgaattagcgaaatcctcatgagaaaaaggtgcaaatccgttgacgatttgtgccttttttcatacgatttgggataagctataaaagagaagatggacggaacaagaggaggatgaggggtatgattagtgttagtccttatattgtggtagacgatgtgaaggaatctcttcaatattatcaagggatttttggcggggatattcatattttaaatgaacatcaagaccgtgtgctgcatgcagaactgcaccttggagaatcactgcttcacttttcagatacgtttggccgcacaccaaagcctgaacatctcagattgattatgcagtttgacaatgaagaagaactaaaggctgtatatgaagcgctggaagctgatggagatgtattggtcgaattacaggatacgttctttggcgcacttcacggacaagtacaggaccgcaaaaatgggttgatctgggtgctgaattatatgaaataaaccaagaccttcaccttcgtgaaggttcagcgtgtagacaaaccctcgcattcggtgtcagtcctgcgtgctggtgctcacgaatgacaaattcgctccgcgccagtactcatcctttctagactgcaaaggttttctatcacgctgaaaagaagacaaaaggctaaaatcaagatcattttagccttttgtcaacaatctggaccttcaccttcgtgaaggtttttttgggagtgcttttattttctgaaaaatggaaaatatgctatgttggaagaataaaagaacaaggagaaaggtggcaaagcgatggagcaaattgaatttcaatcaatccaaacaaatggtgtaacacttcacacagcaatggctggacctgaggatggtccgctgcttatactgctgcatggatttcctgagttctggtacggctggaagaaccaaattatgcccctagccgaggcaggatatcgtgtcgtcgttcctgatcaaagaggctaccatctaagtgataagccagaaggaatcgaatcctatgtattagatcaactgagggatgatatcgtagggttgattaagacccttagtccgaatcaaaaggcgattgtgggggggcatgattggggcggggcagttgcttggcatttggcatccacacgttctcaatatgtagagaaactaatcattgtcaacatgccgcatccgcgggtgatgatgaaggttcttccgttttatccgccacagtggaagaaaagctcctatatcgctttctttcagcttccgaatgtgccagaggcagcactccaagaaaatcacttccaaaagctggatgaagccataggactgactgcaagaccacatttgttctcgaaagaagatgtattaagctataagctggcttggacgcagccaggtgccatgacctcgatgcttaattggtatcgcgcgatcaaaaagggcggctttgaaaagccgatatctaaacgtattttagtacctgttcgcatgatctgggggatggaagacaagtttttaagcagaaagctggcaaaggaaacgatgaagatttgccctaatggtcaactgatttttgtcgatgatgcttctcattggatcaatcatgaaaaaccagaagtagtgaacaaactcatactcgaatttttgaactaaagaaaaaagctctggtcaggggaccagagcttttgtgatttacccaatatgattctttttcaacgaagcaggttcatcgtcccagcattcaatgttctcatggtttggaacggcatttttataaaagactggatctttcccctcttttttctgccgtgaataatcctttaatgctgcaaaggcgactttggacagcatggtaatggcaatgaggttgacgatgaccattaagcccataaacagatcggcaagattccaaacaaaaggaacacttgctacagcaccgaataaaaccatggcaatgaccgcaatacggtatccaatcaaccaggctttgcttgatttaaggaactcaatgttcgtttcaccatagtaataattcccgatcagcgtactaaatgcaaataagaaaaccataatggcaagaacaccagaagcccaaggaccgatgtgttcactcaaagatgcttgagtaagctcaatacctgttaattttgtcgttttatatgcacttgagaaaagaacgataaaggcagtacttgtacaaataatcagtgtatcaattaagacaccaaatgcttggatcaatccttgctttacagggtggctcgtcacggcagctgcagcagcgtttggtgcgctacccatcccagcttcgtttgagaatagaccccgtttgatcccttccataatgacggcacccatagtaccacctgcaaactgctcaataccgaatgcatgtgaaataatcgtctggatcacaccaggcagttcagtaatgtttgtaatcatgacaaaaagagcaataccaatataagcgacagctaagaagaccacaatgtattcagccatcttggcaatcgtcttgaccccgccgaaaatgatgatactaaatccaatagccataatgacgcctacgatcaaacgatttgtgccaaatgaattttcaaaagcaatggtaatggtgttcgactgtacagcgttaaagacaataccgaaagaaatggtgattaatacagcaaacaaaatccccatccagcgtttctttaagcctttttcaatatagtaggcgggaccaccgcgaaagcctgatggatcttttactttatacacttgggcaagcgtactttcaacaaagcttgacgcagaaccaataatggctagaatccacatccaaaaaatagcgccaggaccacccatggcaattgcgatcgcaatcccagtaatgttcccagttccaacccgagccgccatactaatagcaaaggcctggaatggtgatacgccagatttttgtttatttgttccttctttcagaacgatcaccatttccttcagcatacgcacttgaaggaaacgagacctgaatgtgaaataaaggccgacaataattaatagtgcaacaataatatatgaccatagaaaaccatttgttgttgttaataaaccattcataacatcacctcttctaattcatcctatttctttaaaaaatactgagatcccactctttggcgagctttttcagcatcatgacaccggtaatgctattaccacaatcatcaatggcgggaccataaataccgattccacagcctgtctgaaacgggaattctcttcttgcgcttggcggaacgcaagccataattcctccagacacaccacttttggctggtacgcctacgaaagcagcaaaattaccagatgcattatacatgccgcatgtcagcatcaatgcctttgttagtcttgcgatatcttttgggatgacttggacttgtttaaagggatggtagccatcacttgaaataatgagtccaatcaaggcgatgtcctcagttgtgacctcgatggaacattgctttaggtacacttctaatgtctcttcgacatctgattctaaataattggtttcttttaagtaataagcaagagcgcggttacggtgcgcagttgcccattctgattgataaacctcttcattaacagatggacgctttcctattaagttttcgattaaatcgaaaatatatgctagcttttctgtagaagtctttccgggaaggatggaggatacggtaatagctccagcattaatcattggattaaagggcttccctggtttatgcatctcaagacggtagatggaattaaatgcatcaccagttggctctacatctacccggtccaagacgtaaggaacgcctcttcctaaacaggcagctataaagctgatgacttttgagatactttgcagggtaaagggaacgtcccaatcaccatatcgtacagatgatccatctgggcctatcacgctgataccaagttgagaggaattcacttttccgagtgctggaatgtagccagcgttttgtccatttttgtaatacggacgaatttcttctgcccattgatcaacagaagactggcatgcgtgttgtgtattattagaaattgctgttttcatacgattcctccaatcaaaaatcaaaaagtaccctattgaattggcggatgacaaaaaatgcgatcaaataggcacgaaaacatgttacacatcttcaaagaacttgtcatgcgctgcttgtaccactcctttacacctaaatatatgttcaaatgaaggctttggcggcgaaaaaacaaaaagggtttttagtgaaaattcagaaaacgcttacatatagtttcactaaaattgttcattcaatttatcttggaaactacacaatctgacgaaaatctacagaaaaacttacaaataaaaatcagtttgtcgattattgtctaaacaattcccattattgtagacaatcaccaaaatgctgaatagctgaaaggtcaccatgccatctcggtgaatagtcataaaaaaggattttggggaaataaggagctgtgaaaattatttttttgtacattgtgaagaaaagagtctccttgtatactgtggctatgcaaaaaggggaagggatgttagtcatttgagtttaaaccagcttgttaaaaaagacgcattcatattaatttttatggtggtgattgtgccgcttgcaggagaactgaagttttatcctgtgaatgagacgttccggatcagctttggcgcacctgcgtttttcttttgtttattactcttaaggaaatctagaccgttcttgcccggctttttaacaggcgcagccattgtgctttttcgagtaggcttagatctaattcagcatcatgctggtttcgccgtatcattttatcagcaattcccaagtttctttttctattttacatatgcattcctgttctttgccgtccgtacgggacgttttaaacagcgctctatttttattgggatcattggtctgatgattgaattagtggctgattttgttgagttgtttgtgcaatatttagtatttgatacgacgatgacgctatcaaagctgagtgatatgtttctcattgcgtttgctcacagttttgtggtgatcagcttttttaatatgatgaagctgtatgaggcacaatctagagagaagcagatcatgaaacaaaatgaacatatgatgctggtcatttctaatttatatgaagaaacggttcatttaaagaaaacgttaaaacatacagagcatattacgcaagaatcatacaggctttatcgtctaatgcatgaacatgaagcaggcaaggaagtgagtcaggaactgttgaagctcgcaggagaaatccatgaagtgaaaaaggacaatcagcgtatttatgctgggctttcgaagctgatttctaaggaaaatatgcaagactatatgaatgcggaagagctcgttcaaattgtcctccgcattcaagaaaagtatgcgctctctctagggaaaaacatctcctttacatctgatataaaaggcattcatttgcatgattaccatgtgttcattttcttatcgctcattaataatttaatggcaaatgcggttgaagccataaaggatgacggaatgatctcactcgtattgaaaggaagtcatgataaaatagagattcggattgaagatgatggcccgggaattccagaaaaaatgagagacatcgtatttgatccaggctatacttccaaatttgatgcatatggaacaccatcaactgggattggcttatcctatgtgaaagagctggttaaagagcttggcggtacaattaaaatcgaacaaagagaaacaaagggaacagcttttcagctaatccttcctatacaaaatttaatacagagagggtgagtgtatgcggtttttcattgcagatgatgatcgtgcaatacgctcgattttaggacaaatcattgaggatgaagatttgggagaggtcgtggatgaagccgatgatggagttggattagaagcccattcattgaacctaaaaaaaatagacatccttctgattgaccttttaatgcctgttagagatggcattcaaaccatacgtcatattcaccctgaattcaaaggcaaaatcatgatgatttctcaagtagaggcgaaagaaatgatggcagaggcctatgaattagggatcgaatattatattcataagcctgtcaatcgaattgaaattgtcagtgtgattcgaaaagtcatggagcggattaagcttgagaaatcgatttacgatattcaagcttcccttcgccatgtgctgccgttagagccagtgatttctcataatacgacgggtgctgggttgaagaaaaggacgatgaaagaggcgggggaatttctcttatccgaactaggaattgttggagagagcggatctaaggatttactagagatcttgatctatttacatgaaacacagtcagccaattctcatgaggtcaatttcccgccgctaaaacagctctttatcaaaacagcggagaggaagctggatcatggggcaaccgatgtagaagtgatgagggaagtgaaagcggcagagcagcggattagacgcgctattcatcattccttgaatcattttgcttcactaggattaacagatttctcgaatcctaagtttgagcactatgcgtcgaagttttttgactttaccgatgtcagccaaagaatgaaagaaatgcagaagacctcttcatccgcaggatcaactggcagagtcaatacgaagaagtttgttcaaatcttttattttgaagcaaagcagttatttgagggaatgagctgaagaaaatctattggaatgattggagaaaataaacagaaaaagactgctattcctatgatctatcgagatcttcaagtatctttattatttaactgatcattctgatttttcttttttcttgaaaataaaactctcctgtgcaatcgtttgttaaaatagtgaggttagactagaatgtcggaggttttattttgggaaaaattaaacgaaatgcgctctgcccttgcggaagcggaaaaaaatataaacattgctgtggtcaaaagtcaggcggggaacaaacgtctgagcttgtgtttaaggaagctgtacaagttcaaaaggatttaatgaattacgcattctctaaacatcagaaagccatcaatcaattcattaatgagttttcttttcttgcagatatggataaagaaacgcaacagatctcggtctttcatttgagtgtatggggcatctttttccgtccattaacggatcagaaagaaaccatcttccaagaattcctgacaaagaaagcggaagatattacccgtccgaaaacaaaacaagtggttcaatcatggacaggtatggagccatctttgcttttattaaatgaaaaaacggacgagtctctttactttgagaatatggtgacagccgaaaaggttgaagtagatgtaaaaccggatcaaacagtgctgcctgaaaagggaagtctcgtacttggattccctgttcaatttgaagaaaaagcagagtttttcattcaatatacgatgtttgcgaaagagtttacagatacgcttcttattcaagttcgtcagcttgttgaagcatatgaggcaaatggaggaacgcgcagcacatttatgagagaatcattccctgatgtgttgaagtgtttgtttgcgaagcaagaagtagaagaattagaaacatctgctcaaacagaaggcgatacaggtctaacagcagatcgcatggactgggcaagtgacgttcaactggaaacagctaagctgattgaagacggaatgaaggaacacggggaccaaagcctgactgatggcgctttaaccgtgtggaaggcctattgtgatcagaaatcacctgtgatccgtaaagcagcatcatttgctgcgggaatcgaatattacattcattcacttgcaagtgatgccccgctttctcaagcgcaaatagcgaaaaagtatggcattagtgcgtctactgtatcaagccgtttcaaagatattgaaaaagcggtgaaagaagagcaagaggcgacggtatagcataagaaaagacgcggcaccttcattgggccagcgtcttttttttagttcaagattatcttgttttaataaaaccgctcatgtactgtgatgtattataatcgttaaggtcaattttccactgaccatccccattacgtttcattttcacttcgtattcagccgggctggagactgggggaagcttctcgaattcagatgcgtacaagtttaagcttttcttatacaattcttctttagagcggatcttgccgttgtaaaactcatctctttgcttgtctagcttgtcttttaagttagaggcatcaatacctgttacttgagcgacaaccttcgcctcgtcattagagatggtttttacacttgtttctactttggttttatccttcatggtgtcttgaatccgtttgtacattgacagaatatcacggtcacttacttcattgccgtacatgccggcggttcttttgaagtcttttacgaacatgtcgtggtatttattcacgacatcggattggttgtcacctgttaaatctgcaaattgatcgttctttttgtcaaatacaatgatatccgtataagcggatagcgcttttgcagggttatccagctttttcgctgtatctaatattttgtttccatctaggttgatttcaatcgaatcactgtttttcttgatgctgtcttggtacacgaactgatattttttccctttgtctactaggaaataaagagcacctgtttgagattttcctttgttcaatgaaccgaggtcaagacggtctttactgccgtaaatttttaaatcagatactttggcatcgtcctgataaagggagaagtcagagctatataatgatagagctttgtcacctttgtttgtaatcgtcaggttgacttttagcaccaattcattgtctcttagtgtagttgttgagtcttctggtaacgtatattcgtagctatcgacttttacctctgctgtttttgttgatttttgatcagcgttacttgattttgctgagctctggcaagctgcagagatgatcatcacgaacgaaatcatgaggagtgcacttatttttttaagattcacagttgatgctcctttgcttttctttcgtcatttcattcccgctatctgactatgaaaaaagaaacagataggatggtatattcgggtgttacaggggaaaatctccttatgacgatttgcacttttcattctatcgaaattcaatcatgatgaggaataggttttagtccctatctttgaaagtaatttacataaaaatcattaataaaaggaaatttgtaagtctaatatactggtcaataagaattaatttatagatttattatcagttttaaatgttttttaggtaaaaatcttgaaatgagggtgttactgcttcagagagcaggatacttgaatgttgtaaaggattcatgggaaaataaggatgattaagcagataagggagatgagcttttgaaaaaggtaacgcttggacgaactaatttacaggtgaatccgatagggcttggtacgaatgcggtaggtggacataatttgttcccgaacctgagtgaagatgccggacgagagcttgtggagacagctcttgatcaaggtgtcaatttcttagattctgcttttatttatgggctgggccgttcagaggaattgatcggtgagattattgccaaaagaggcggtagagaaaaccttgtccttgcgacaaagggggctcataaagaagtaaacggacaaattgagctggataacagccgggactttttaagagagcaggtcgaacatagcctgaaacgactgcaaacagattatattgatttatactatatgcatttcccggacggccggacgccgctggaagaagtagcaggcacattaaaggaattgaaggatgaagggaaaatcagggccattggtgcatctaaccttgattttgaacagcttcaagcctttaatcgagatggctacttagatgtgcttcagtcagagtattctttgctgaaacgtgaggcagagcaggatcttctcccatactgcgtcgagcatcgtatttcctttattccttatttcccgttggcgtcaggtttgttgactggtaaatttacgaaggatgcgacatttgatgatattcgagcaaaagatccgcttttccaaggcgaggcgttccttcaaaacctcgaaaaagtagacaagctaaaggcaattgcacaatcaaagaacgccgaaacggcacacgtcgcactcgcttggcttttagcgcaggacggcatcgacgccattattccaggtgcaaaacgagctgagcaagttcagcaaaacctaaaaacaaacgaagttcaattaacaaaagaggaaatcaatcaaattgaccacattttctcttaatcaaaaaaggtgcttagctgcacctttttttatgacatcgtgagggggattttgatgacgagccgcaaatgtggagaacggtaagtaaaatcaagagtaccgtctgccttttcaacaagctgatgaatgatatacgtccccattccttgatgatcgccgccttttgtggagcggccaaagtttttgaacaaatggtctaacacgtgtttttccattccttttgtgctgttttcacaatggattaaaaagagcccactccgaatagaggtcgcaatcgagatgctgccctctttcccggcttgcttcgcttcaatcgctgcgtctagggcattatcaagcaagtttccagtgaaactaacctgatccgccttagaaaagggaagcgatgaaaaaggtgcttgaaggtctagagaaagggcaatgtcctctttttcagcccgttggaaaaaggaatgcagggttgaggccaaataagcattttctcctttaatccaagggaaatgtttcacgtattgctgaatcaaatccttgatctcatgctcgtcgttcgacgcggaaaaggcatttaaatgtctagctgtttcatgatgtttactgcgcagctcaagcagcaattcattggttcttgattctgcgttgatcagttcttgaagccgaccgtttaatcgtctctccgtctgcatcatcttcaatgcaaggatatctgttgtgatgatgatcacaaaagccaaaagagggctccatccatttccttgcgtcagaaaaagggaaaggcctgcacaggtaaagagcacaaaagcacccaacatcacataaccactcacatgaggcaaaaaccttttgtatatgaaaaatatataaagacaaatcacacaaaaagtgaggagccacagcactcctgatgatagatgcagaaaagcttcagctgctgcatgaaacgcaagacctaggcatatgagagcatacatgcggaatccaacatagaaagcgttcacgttcgttctccttaaaaatagtatttcttaaagtattctaattgctgcttggtcatcatggcttttttatctgtaccttcaaaagacacgataaatgaatttttggcatacgccgagaagttcttaatgtaatgaatattgatgataaacgatcggtgagagcggataaaatctttttcagctagatcgccctttaactcgtttagtgtctgatatgtctggatttctcctgttgttgtgacaatggtggttgacctgcctgttcgctcaacaaaaatgacatccttcttttgcagcacgtgaatatctgactgctgcttaatgagaagccgtccatgaatgcttttctcctgcttggtggacaagtagcgctctaaggatttggcaattcgatcggcttggtagggcttcataatataatcgtgaacatttaaatcaaacgcatggaccgcatatccgctgtttcctgtcacaaatacaacatcgacattcagtgcatgagagtgaatgagatccgctaattcataaccggacattccgggcatttcaatgtctgcgaacaacagatcaatatctccttttttgaccttctcgtatgcatcctctgctgactgtgtgacaaagacaatctccacagcctccattctgcctacaatggcatgcagcttttctaaatctactcggtaatcatcaacgagacctacttttatcataaaaatcacctatgactcttcttattatttgtctattttaccatttgtttttttaaaatagatcatttcaagacagaaaaaggacgtttcgcgacatttttatgtcaaggaagcgtcattttttctatcatagacttagaaagttgaaaggggcgaaccacatgattactctcagcgattgcagctgctggtttaaagataagaaaaaggtcgtaaaagcgatgaagcatatgacgttctccgtgaaggaaggggaagttgttggcatcctaggagaaaatggtgcagggaaaaccacattattacgcgccgtagccacattattagaacctacgcacggaacagtcactgtcgcaggctttgatacggtgaaagaatcaacagaagtgaaaaagcgaattggtgtcttgtttggcggtgagacgggactttatgatcgtttgacggcacgagaaaaccttgaatactttggcaaattgtatggcttagatcagcatgaaatcaaagcaagaatagaggatttggcaaagcgttttgggatgagacaatacatggatcgcaaggtgaaaggattctcaagaggaatgaaacaaaaggtggcgattgccagaaccttgattcatgatcctgacattattttatttgatgagccgacaacaggcttggatatcacatcaagtaatattttcagagactttattcatcagctcaagcagcaaaataaaaccatccttttttcaagccacatcatggaagaagtcagccagctttgtgacagtgtcatgatgattcatcaaggagagcttgtgtataaagggacacttccagaattatatacacaggaacaaagtgatgacttgaactatatctttatgtcgaagctcgctagggggatttcataatgtggaaaaccgtatttaaaaaagaaatgacagatgcgctaagagaccggaaaacgctgctcttaacagtgctgattcctcttttgacgatgcttggattggtgttcttttatgaaagcatgattgcagatccaggagatgaaacctatacggtcgcagtgaatgaaaagcttccaactgaaatgaatcaaatggtcaaagaggtcaaaaacctcacacttgaaacatttgatgacccgcagcaagctgtcaaagatggaaaggcgaatgcttacctggaaatgccgaaagaggcagacgacatgcttcagcatcaacaatcatttgcaattaaaattcatgggtatacaacagatgatgattcggtcatcacggttcaaatgctgcaatccttattggagcagtatcaaaaccaagtcgtagaaaagcgtttagccgctgatcaaattaatacgtctgttgttcacccatttcaggtgcaggccgttgatgtagaagagggcgaagaaggagaaaatggcatgacctctatgcttttgtcgattcttcttccaatgattttggtgacttccgttatctcaggtgccttgcctgctgcgcttgatattgtagcgggtgaaaaagaccgaaaatccattgaagcgttgttcctgacacctgccagcagactccaaattctcatcggaaaatggctggctgtctccatgttcgggattttaagtgggattgtggcgatcggtatgctgcttttatccacgctgctctttacagaaaagctaaaacaagcactgaactttggtgatcaaatgtggagcattatcgccgtcatgtttgcggcgcttatcatcttctccttcatggtatcgatgattgaactgctactcagtgtcgtttcaagctcagtaaaagaagcacaatcgtacatgtccatgatcattacattaggtgtgatcccaatgttctttaccatgagagcaggtgctacgcagctagatacgtattactttgctgtcccattccttaatattcatgcgctgtgtaagcaattgatgtttggtatcatcgatccaatgtcaatcactctgacactcggctcctcagcactggcagtcgttatcctgtttgtcatcgtcagaagcttgtttatgaaagaaaaatggatgcttgcgaaataaagaaagtaaaaacttgtagattttatctgcaagttttttatatccagagatttatataaaagagattcacgatcgggtgaaaggaatggcataatggaaggcggaacttacattattatcctaattttttaaaaagaggtgattcgtgtatgtcttatcaaacagaagacgatgatgtgctagagctatgtaatatatatgctcaacaaacacaccattttgaagcgtttattttggggaacaggaaaggattattggaattaagaaaagcgatagatgaggcattagaaacgggtagttccgttgcacatttatatccatctgattttgaaggatatgaaacgtatattgctttagtagacgatgagcaaaagtttgagaaattaatggatccttatgtagaggaatacgcacaagaggaggatgcggttgatccggttgaggtgataaaagagtatgaagcagcaaaagaaaatccctcgtaatagaccgtatcttactttcttggctgtaattatcaaacgaaaaacgataagaaaaaacccccggcatcgggggtttttcattagttcttgatgaacttttcaactaatgagcttgttttgtaatcgttcaaatcaagtttccattggtcgatgtcatttttcttcatgttgacttctactgtttcttcagaagatgatggtcctaattttttgaactcttctgggtagatcgagagtaaatatttttgtgcttcatcataagacgcagtacggtttttgctgtagaactcagtcgctttttcttttagacgatcgacaagcgggcttgcatcaattggtgtaagagttacagtcacaacggctttatcaccactgatggcttttgtttttgttgatacttttgatttttcagctaatgtttcttttacagcttttaaaagcttatcaaggttttcgtccttcgctgagctagaagaaatacctgatgacgtgatgtagccttgtttgaatgatttatcaaattggtttacaacagttgatttgttatcacctgttagtttttcgaactcgtcgttattcttaccaaaaatcatgacatcaatataagaagaaagagcttttgcagatgcttgaagtgtttctgcttttttcattaagtctttacctttaatatcgaattctagtgttttgtcatcttttttagaaccactacctggctcattgtacacaagctgatagtctttttctttgtcaacaacaaagaaaagaccgccttttgatacttttcctgcatttagagagcttgaagataatacttcgttgtagtcatctggagagatcgtagacacctgtgagtcatcttggtaaagcgtgaagttgcttttatcaacatttagaggctctttgctgatattttttacagatacgttcacttttagtacatactgatcatcctgtacagatgtatcgtattgaggtggtaatgtgtactcagcactttctacctttacctctgctgcatcaagggattttgtatctttttcctttgcagctgacttttcttttccaccactacaagcagcagcgacaacagtgacacacaagatcagaagaaacagggataatttctttttaaacatgagatgttttcctcctcgggttttatggtgaatttcattggaaatctttagttcatatcattctttttgcacaaaaagaaaaatactgtatgttttttactgtagaatgaagcgaaagtactgtcaatacttcagtgcgtttcttaggttgcacagcttcaaatagtaaaaatgacactaagttgaaaggagaaacttgtaaattatgatttgatatctcctgtaaaaactcaacattttatattttaaggttttgagtcggattgttgaataggttcaaatgactgtttttgataatggtgtagcaattagaaggatttttatgacttgtaaatgagtctatagtaatgaatattttttcctgttatgcgcatgattacttggtttgtgtgttgttgccagagagacacatgtccagcaaaatattgaggtatttagacaggctctcgacattgaatgtgtcttttcccgtcaaaatggcagtcatctacacagaaaccctacataaaataaaagagaaacgaatggaggtggatgtatggcagtggtaagagcgacaagctctgatattgatctcatggccagactgctgagagcggaggcagaaggtgaagggaagcaagggatgctgctcgtagggaatgtgggcattaaccgattgcgtgccaactgctctgactttaaagggctgcgtacgattccacaaatgatttatcaagagcatgcatttgaagcagtcacacatggttatttttatcaacgagcacgagaaacggaaaaaacacttgcgcgtaggaatattaacggagaacgattttggccagcaaaattcagcctttggtattttaaaccgcctggtaattgtccaccgacatggtacaatcagccgtttgtggcaaggtataagtcgcattgcttttatcagccaaccgctgaaacatgtgaaaatgtctataacaccttttagcttgatgaacagcacaatcctcttagtcaacgattgcagagggttgtgtttttctttttttcaaaatgggtaaccattgtgtatcaactagatgaagcacgtgataggaggaaataaagatgtatcaagatttaaaaggaaaaacagccattgtcacaggttcttcaaaaggaatcggacaagccatcgcattacgatttggacaagagcagatgaatgtggttgtgaactataaaggtgatgaagagggtgctgaagaaacggtacaagccattcagcagaatggaggtagggcggtgaaagtacacgcggatgtctccaaagaggaaggaattcaagcgatcatggatacagcactggagcatttcggtacagtcgatgtgttcgtcaataattcaggctttaatggtgaagaagcgatgccgcatgagatgacgctcaagcaatggcaaaaagtcattgatgtcaatatcacaggtgcctttttaggggcaaaggctgcaatcgcctatatgatggagcatgacatcaaagggtccattttaaatatatccagtgtccatcaggaaataccgcgcccgttcaatgttcactattccacttccaaaggcggaatgaacatgatgacaaaaacgctggcccttgattatgcggaagcaggtattcggatcaatgcgattgcaccaggtacaatggcgaccgaatcgaatgatgatttgcaggatgaacagaaaaaacaaaagcagcttgaaaagattccaatgagagcatttggcgaaccgaaggagattggatccgctgctgcattcctcgtatctaaggaagcttcgtatatcacaggcaccactttatttgtagatggaggaatgacgctttacccttctcaaatcaatgattaatccaaaaaacatccgcccgatcagccggcggatgttttttgttcgtagcggtgtgcggctttggctggtttgccgagcagcatcgggtacttgctcaggaaggagatacacggcaccataagcagcaatgtcccaatcgtgtaaaagagagtccaagagagctgcgctgtatctgcaatattgatgccaagtccataataaacaaatgctttcatgatatcgatgccggcaaactgcaagacaagaataacaatggaatttcgaccgagatacgtcaaaataggggacgttttgaatttgaaacttaaataaatcacagcagctgaaccgagcagtgcacatgcatagaaaagaaaaagatcaccatagtcattcacgcgcatatcgatccgcgaattaaagctttgcatgtaagccgtcagtacaagcagacctgtacaaagaagaagggttgggtctgtttttaattccacaaaccattgctttgccaaaaatccgattgaataaaacacaacagccgtcaaggcgacattggcattccacggcagactttggtttaaaagcaaggtagaggcatatccagcacctccgcaaagaagggtcagtaagctcaagacagcaggtttcccttttgtcagacggtgcataaagaaaaagattatttccactaaaaagagcgtcgttaaaaaccagatggctgggttatgtgtgagcctagcttcatctgcattggatataaaaatacctgtaaacggaacgaaagggtcaatatccgtttgtcccttaaaggcaaaaaaacgagtaacggtgaaccagaaaacatacgtaatgatggagaaatagagatagggcaagagtaagcttttggctttcttctgaataaatgacagagcagggcgtgaggatgatcgaaacatcatgcctgatagtaaaaagaaaagcggcatatgaaaagagtaaatgaattgcttgagcggatctggaatgggcacatgcgccatgaccacgagaagaataccaatccctttagccgcatcgacccagtcgagtctcttattcataacctgtcatctccttccttctagcgtcgtaaacggttcttttatatgtacctctactatataaaaggtacaccccttatgcgtttacagttcgctaacgattagaagacacatttgcgattagatgacaggcggaaggattttgacatctctatgttacatttcccattttttatgacaatgtaaaaaaagaagccaagggaattggcatcaaaataattctgcgattcgtttgaaggagcgctgtttttctatcggatcaaatgaattgttgagaatcatgatgtcatccgtttgatagcggtccatcaagctaagtaattgctctttcactgttgcctttgagccgacgatcatccgctggcggtttagtaacacttttttcttttcctgcgaggtgtagtgataagtactggcttcttctatagaaggtacgcggctgtccagtcctttttcaacacgcagcagccataaatctgtactggtggcgatccgttcggcctcttcatcggtttcaccacaaatgacaaacacggcaaacattgcgtgcggctgtgtggaaaagacagatggagaaaagtgagaccgatacgtctcaaatgcttgtttgccgcgtgcagggtgaataaagtgaccaaaaatatagttgatcccaagctccgctgcttgcatggcactattttctcctaaaccaagcagccaaaccggcggatgagtatcaatatgcggagaagctttgaccccagcatgcgggtgtccagaaggcaggctgtctgataagtaaaatagaagatctttcagctggcgatcaaactgagatagatctttatgcacgccgtctgtcaaagccagtctcgtcctttcaatcccgcccggagatttgccgacaccgatttcaattcgtccaggatacagagcctcaagctgccgcgtgacctctgctactttaaaggggctgtactgcggaagtaaaatgcccccagacccggtacgtaaggtcgatgtatgagcggcaatatgtgccattaatatttcaggtgctgtactagcgagccctcttgtgctgtggtgttcagcaaaccaataacgctcatacccaagagcttctgcaagctgagccagtttcgttgtgtgaatcaatgtctcttgtgctgtctgacctttaggaatagcgacttgatctaatatgtgaagtgatggcatcatcaacatcctttcggtaatacgttgaatttaagtataaagaaatccttgaatagaaggaaacgaaagggtttatcctttgatctcatgctttaacttttctatatcaacatatgaaaccacatcaatacgttatttatcagcaagagctgtggacgggaattttcgacaatgtttcacatgaaacacttcatttacgacataaactattttcaacatggatctttcgttaaaaaaatatcatctgtttgaaacctatcttgaacgtagatcgtatatactagtaaatagaaaaaagagtaagaggctccaaggtcatttcatgaattttgtcgaattttcatgtatgatgattttaatagagtccatcgcttaataaatagatttttattatgcttgaggagtgattgatttggcgattacattagaaaaaggtcaacgtattgatttaacaaaaggcaaagcagggctgacgaatattcttgttggacttggctgggaccctgtatcacaaggcggcggatttttaggtaagctgtttggcggtggaggcggcgctgatattgattgtgatgcttcagtgctcatgctgaaaaatgataaatttacggaaaataaagatttgatttattttggcaacttgaaaagcaaatgcggcagtgtagagcatacaggtgacaacctgactggtgaaggagacggagatgatgaacaagtcctcgtcaacttaagaaaggtgccaggcaatgtgaataaattggtgtttgttgtgaacatctatgatgcacttagaagaaatcaacattttggtatgattcaaaatgcgtacattcgcattgttgatcgttcaaacaatcaagaattagtaaaatataatttaaaagatgagtatgcagggaaaacatcattaatcgttggagagctttatcgtcatgaaaatgattggaagtttgcggctgttggaaacggtacaaatgatgcgaagcttgccgatattacgagaaactatatctaatcagaagggagagattcctagtgggaatttctttagcgaaaggtcaaaaaattgatttaacaaaaacgaatccaggtttaacaaaagtggtagtaggtcttggctgggatgtaaacaagtatgatggcggacatgactttgatctagacgcaagcgtattccttttagatgcagcagggaaagcaaactctccatctgattttgtcttttacaatcaaacaactggcggtggcggaagtatcgtacatacaggcgataaccgtacaggtgaaggagatggagatgatgagcaggtcaatgttgatctttcaactgtaccagcgagtattgagaaaatctccttcgtgattacaatccatgatgcagaagcacgcagccaaaactttggacaggtttctaacgcttacgtccgtattttaaatgcggcatcaaatgaagagctcattcgctatgatttggcggaagacttttcaattgaaacagcgattattgtaggtgaattataccgtcatggcggagaatggaaattctcggctgttggatcgggctatcaaggcggacttgcccgcattgcaacagacttcggtttagatatcgggtaacgacccgttttcatattttcaggagacaggagagatacgaatatggcgattcagctttcaaaaggacaacgtgtcgatttaacgaaaaccaatccagggctgacaaaggtgatgatcggacttggctgggatacgaataaatattctggtggagccgaatttgatttggacgcttcggctttcttagtggatgcaaacaatcgttgtcagcaagatacagactttgtgttctataataaccttcagcatccaagcggcagtgtcactcatacaggtgataaccgtacgggtgaaggagatggagacgacgagcaaattctcgttgatttctcgaaaattcctgctaacattgatcgtatcggaattacagtgacgattcatgatgcagagacgcgcagccagaattttggacaagtctcaaatgcgtttgttcgtgttgtaaatgaagagggcggggaagaattgattcgctttgatttaggggaagacttctcaattgaaacagctgttgtggtatgtgaactataccgccacggaagcgattggaagtttaacgccatcggaagcggattctctggcggacttgcagctctttgtcaaaattatgggttagaagtataaacgagagaaatcaatcgattcaagaggcgctgccaatgactcatatgaggaccttttccaaagtgagaaagaaacagcgatcaagaataacagcaggcgaaagcctgctgatgcttctacacttataggaggaaaaccagttggacattttgaaacatatgttggacacctatgcctcgttttttgattggcatatgtgggcagaggtattaacaaaccctgtctcttggggactcattgggacccttgttgtgcttgaaggattgttatcagcagataacgcacttgtattagctgtcatggtgaaacatttaccagaaaagcagcgtaaaaaggcattaacctacggattaattggcgcttatttcttccgttttctattcattggcgtagggatgctgcttattaagttctggtggattaaggttctcggagctgcatatttagcatggcttgtcattaagcacttctggttaggtgacggcgatgacgaagcgaaggaattgaaaaaagaaggctggatgattcgtgtatttggcgtgttctgggcaaccgttatttctgtggaaattatggaccttgccttctcggtggacagtattcttgcggcattcgcagtatctgaggaagtatggattctgctattagggggaatgcttggcattctcatgatgcgtacagtggcacagttattccttgtccttattgaccgtattccagagcttgagaataccgcgtttattctcatcgggattattgccatcaaaatgggcttaagtgctgcacatattgaaattccgcatcttgcattctttgcgattattattctagcgtttatcgggacgtttattgttcataaaatcaataagaagaaacatcaagatgtgacaaacgaagctgcggcttcaaaagaagaataggatgatcaaaaaggaatggagttgactagaggctccatccttttttgaatcatcaggttattgattttctctaaacaacaggaggtggcacagcatgcggtattttcgatttttatcagaggcgaggcagcaagatctttttttcaagcggccgggggcgatgcattcacagacaccgaggcatgtacttgcgcatgcattaggtgctactttgtatatgcctgcgacacgacaagatatagcagatatgctgctgtcgcagaaatatgaagcgctttgctctgttgtattttgcttggaggatgccatcggtgatcaagaagtggacatggctgaacagaatctagtggcacaactggccagtctcaaagagaaagtcacgcaagctcctgaaacggctgcacatttgcctcttatatttattcgcgttcgttcaccgaaacagctgcttaaaatggcagacttgctcggttcctctcttcaattacttaccggttttgtgttcccaaagtgctcggtccataatgcgaaggattatttggacagtctgaaacaggcatcgtcccaaacgcagacagtactttatgggctgcccattttggaaacacccgatttactagaaaaagaaacgagatatacggtgttgtcagaattaaagcagatctttttgaatgacgaggaatatattttgaatattcgcattggggcaacggatctttgcggtttgtacgggattcgccgtgatcgtgatacgaccatctatgagatcaatttgattgctgatttgatcacagatatcatcaattattttggccgttcctttgtggtatcaggtgctgtgtgggagcattttggccctgcacgaaaggaacaaaagccattcatacgggcactttctcataagagtggtgaatcgtcttcatctgaatttgatgacgtacaaggtttactcaaggagacaaaactcgatgtggctaacggcattcatggaaagacggtcattcatccaacacatctcaaaccggttcaaagcatgtatgttgtaacgaaggaagagtatatggatgcattaagcattcttgaacatgcagacggcacagttggcgtaatgaagagtactttctctaataaaatgaatgaaacgaagccccattacaggtgggcagagcacattttaatgaagtcagatatttacggggtgtttcatgaaaatagaagctatatcgacatactcacagaagcagaagccgcatacgctgagcatcttggaacatatggaagttgagcttgatctcaaagaaggtgcgcttcagctagaaaaagagcatctttttgacatggctgcaagggtgaacaaaaaaagagcctttttattcgttagtaaggtgcttggtaagcacattcctgttcatccagtaaaaccgctccttgtctcgggccttttagccatggcgtatgccaaagagcaaacaggcaagacgtctccacatcaagaccttttggcagaagcactcaagacagatgaccacacggtattaactaaagcctatgaagcgctcaaaaaggagaagctctcagtaggaaaacagccgatcgtgatcggctttgcagaaacagccacagctcttgggcacggtgtgtatgacgtattagaaggtgcatcttacattcatacaacacgtgaacagctgctggatcttgatccttcattggtatttgaagaagagcattcgcatgcaacggatcagctttgttatgcagacgaagcattacttcgcacagaccgtcccatcgtgctagttgatgatgaagtcacgacaggccgtacgaatatcaatatcattcgggatcttcatgcaaagcacccgcggcattcttacacgattctgtctattttagactggcggacagaggagcacgagaaagccatgtgtgagcttgaaaaggaacttggtattcacatcacttcattgtctttattaaaagggcaaatggtctttcggggcaaaacgctggatgaaccagcttattcgtatgagattgctgagcaaaaggatctgccaaatctctcttttcactctcttcaatctttctttcagcaagtgccatatgcacgttctcatgcaaccaattcggctggtcattcgccatatatacatgaaacgggccgttttggtttaaacgcagcagatacagcagccatcgaccaagcagctgcagaggctggactgaaaatgaagaaggaacgcaaaggaaagcagacactttgtttaggaacaggtgagctgatgtatgtaccgatgagactggctgcatatatgggagagggcgttctctttcattcaacgacgagaagcccaattcatcccgttgaaaaggatggttacgctgttcaaaatgggttcacctttgtaagtccagaggatgcccgaattcagcactacgtgtacaacgtaccaaaaggtcaatatgatgatgtatttctcttctttgagaaaaaggtctctcaggaggcattgcttccgcttgttcatttatttgctgagcggcatgtgaagcatgtgcatattgtgactttatcagacgaggtgaaggtgaatggctaatgtgtatacaaagatgggaagctatccagagcaggatgtaaccttcttactcaaagatttatcatccattgagatggagaaaagtacagaggagcgggagcgttccattcagagtggtgcgcattattcagaaatgctgccgattgaatataaaccgacgaaatcttatatggatttattctatgaatctctgaaagaaagtaaggaaaaggtagcagaagcagtagctgtagtagccgaacagattgtgaaaaagcgaggcttccaaacggtactttgcagtttggctagagcgggaacgccgattggggtgctcatcaaacgatatattcgaaagacatatggtcttgaactgcctcattacagcatttctatcattcgtgatcgaggaatagatgagaatgcgctgcattatatgctcaaggaacatccaggctatgagattgcctttattgatggatggaccggaaaaggtgcgatttcgagagagctccaaaaagcggtgcttgattttgaaagaaagtacgggattcgtctttctagtgaactggctgtactcgctgatcctggctattgtacacatgtctacggaacgagagaggactttctcattcctagtgcttgcctgaattcgactgtatctggacttgttagtcggacggtactaaacaaccgctggatcaatgccgatgatttccatggggcaaaatattatgaagagctgcttgatgaggatgtgtccaatctgtatgtggatacaattgaagaagccttttctagcctcgaaccaaatatagaagagaaagcagagaccatcctcacgcaaggaatgcctgcggattggcgggggatggcgtccattgaagcgatcggtcaggagtttcaaattgaaaacacccatttgattaagcccggtgttggtgagacgacccgtgtgctgctgagaagaatcccttggaaaatcttgatacagcctggatctcaggagaagctaaagcatattttgcttctggcagaggacagaggcgttcctgtcattgaatatgaaaatatgtcctatacgtgctgtggactcattcgtccgctggagcagatgtcatgaagacaagtgcgtttgccagtgatttagacaggacactgatttactcacatcgagtgctggatcaatatgagtatgaaggagattatgaattagttgagatgctagatgaacgtccgctttcctatatgtcggttgaaacgaagaagtccttacagacgattcatcaattgggctggttcattccagtgacgacaagaacgaccgctcagtatgaacggatcaccttctttcagcaagagatcaaaccggagtatgccgtcacgacaaatgggggctgtatccttcatcacggcaagccgcttgaggattggcaggtcattgttgatgagaggctcaaagcgtgtatgtcagtcagagagatgctaagagccatctccgaactgccagttgcggcatgggtgaagcgtacccggacagccgagggaagatttctttatttgattatgaaggatgagtatctgtctcgcattccacttgctgaattgaagcagtggggtgaggagagaggttggcaggtgtctctacaagggcgaaagctttattttattccggcaccgctcaataagtgggatgctgttgcttttctaaaggaacgtctggcgcttgaatatgtatatggtgcgggtgattccctcttagatgcaggactcattcgacaggcagatataggctttgccccaaggcatggagaagtgctcgactttgatccattgcttgagccgacagcagcatctggcatggcagcagcagatgaaatcacggcttgtgtcatgaagcagatgacaaccgcaaaaaagccttcgattcgatagcagaagtagaagggtgaatgatatgatagtagtagctttcaagaaaatataggagaaaggaaggagcggcgtgagttataaagaaatcaatattaaccaaacacgggcggagcaggaagcctggaaaaacgtgctgaaaaagccgctccctgaaagagacggttatgtaaaggacgagcatacattgtccttgccgcgtctcgccgcccgggtccttggaactccacatgatgcaaccgattattttatttatttacatgaattatatgaaacagatggcattcatattttaagtgaaacgctcaatcgtcatattgagccggagcattttcaagcgcttcaacgcattcatttgattaaccaagaagaaaagggattgtccgtgaatcgctttgtggctttcttagatggtgaacagctgattgtacgccatccaaatcctgtgatgaaccggcatatccgcctttcattgattaaggtgtttgagcatttcaaacagctgcatgaagggggatttcagcatcccgattttcgccgggttttgctggatgtagtaaagttctcaaataatcatctaggtccatggctgaaggaagtcaatatagaagaaaaaatgccggctgtcatttggtatggagaggcgaataaaagtcagctttattttctttactatgtcatgctgattggctgtgatgttgtgctatttcatccagagggcgaggattcattccgcgaactagatccagaagaaaagctgacttttattgatcagtatccggggacttcaaagctggaaccgttccctactgaaaagcctgagaggaaatcaacggtggcgtaccgctcgactagagagcttgaagaggtgctccatacggaagattcaatgctgtataagccgtggcaattcagagatcatacccctcattctattacgctgaagacaacgtatgatgagctgtttttaattgcaaaggaacgctcctttatccgccctaattttcaagcagaccgtgatacgatacagattccgaatctctttgcgaaaatgatgggggtcacacgagacaagcgtgaatactgggatcgtatccacacgttaatggaatggaaagagacgaagaccattcgccattttccttttacgaaagaagtgtcttcgaattatcaatttcattatcagcatgccctttcgtctgctggagagattgatcctgaattattaatgaaaagcaatgtgtggcagttttctcatctatatgaggggacgcagcgtgcgatagcagaggcggtatctcgaatctgtcagcatccgaagctattaaaagaaggcaatgagactgaatcagatgtccgtatttatttattcaaacaggtactgcatatcggccaggagctcattgaactcattcaaacttttgattatgcacaaaccgtaccgaaagtgattttatatcatacggaatataatggtgagctgactcgttctgatgcggctgccctcatttttctaaatgaaatgggtgtggatctcttcgtgtatcatccgtcgggataccagtgtatcgagcggtatatagatgaccaattatttgatacccattggcttgatgagatggtcatgaaccaggagtttaaagagccatccatcgtcagaaaattatttcaatccattaaaaaccgataaggagatcaaagcttatgacaaatacaaacggaaatgacatcatttcaattgataaagaggaaatctccattgagaaggcagacgatatccgcgttcagcttcgaaatgaaccagaagtgcaaaatattgcaagacagatcgatgcgaaaaatcaactggagctgcttgaatacggaaaacagccagccgttgaaatctctaagttctctgatcgtattctttcgatgatgcgctcaactagtgtcactgactcaggaacgatgctgacgcagcttggaaaaattatggatcgttttgataaaaatgattttgacgagccaaagggtggtttactgtcaaaaatctttaagcgcggcggcagcatgattgaaaagattttcagtaaataccaaacgctcggtgcagaaattgaaaaaattaatgtggaaatcagtaaatataaagacgaaatgaccaaatcgactgtgacgcttgaagaaatgtatgagcataacattcaatactatatggagcttgaaaagtatgtcgttgcaggtcaaatgaaaatcgaggaattaaagcaattggttccttcttatgaagaaaaagcagctagtggaaaccagctggcacaaatggagcttgatacacttcgtaacggcattcaagcgttggaagagcgtgtatatgaccttgatatggcacggatggtggctcttcaaacggcaccgcaaattcgcctgctgcagcgtggtaatacgaaactaatcggtaaaatcaactcagcgttcatcatcacgattccgatctttaaaaatggcatcattcaagctgtgacagcgaagagacaaaagcttgtggctgattcaatgagtgaactggatagaagaacaaatgaaatgctgaaacgaaatgctgaaaacatctcaagccaaagtgtggagattgccaaattgtctggacgtccaagtatcgacattgaaacgatcgaatcttcctttaatacgattgtacaaggaatgaaagagacgaaacagatcgaagaagaaaacaaacgattacgcgaagatggaacaaagcgtatgcttgaattgcaagataatattaagcgagctgccctagagtcctaaaaaataagctgtctgtaactaaagttgcaggcagttttttaatattttaattaaaatttgaatgaaaaaggtttctatgtgaccattttcgggtaaatcctgttcaggggaacggttcacccatgtttgaaaaagtccgctatggtgaggattcgagttattttttagcacaattaggaatttcaagtaaaatattgtctgatgagaggaaataccccgtaaaatatgttgtttatgaagcattctataggatttacgagtaatacggcgtataaactctaatcaccagacctcttatatggaattcatacatattgtgcggaaataagcgaattctaaagattgttcgcatcataacgcttatgttacggttattaagatgctaatttggagggaaaatatgaattctgaagagagaactatcaaaatcaagataaataatgtatctaaaattttcggtaaaaatgctaaaaaagcatctcaaatgcttgaaaaagggaaaacaaaaagagagatcctaaaagagaccggcgcaacagttggtgtcaatcgagcaaattttgatgtgtatgacggcgagatatttgtcatcatggggctatcagggagcggaaagtccacacttgtgcggctgctaaataggttaatcgaaccaacctccggagaaatatatattgatggggatatgataacgaatatgtcaaaggatcaattgcgtgaagttagacgtaaaaagatcagcatggtcttccaaaacttcgcattgttcccgcaccgcaccattcttgagaacacagagtatggtcttgaattacaaggtgtagacaaagaagagcgccactcaaaagcgcttgaatctttaaagcttgttggacttgaaggctttgaagagcaatatccaaaccaattaagtggtgggatgcagcagcgtgttggattggcacgtgcattagcaaatgatcctgacattttattaatggatgaagcattcagcgcactcgatccattaattcgtaaagacatgcaggatgaattgcttgagcttcatacatctgtagggaaaacgatcattttcattacccatgatctagatgaggcgcttcggattggcgaccgcattgtgctcatgaaggacggaaatatcgttcaaatcggaacaccagaagaaattttgatgaacccatcgaatgaatatgttgaacgtttcgttgaagatgttgacctttctaaagtattaaccgctggtcatattatgaaacgtgcagaaacagttcagatcgacaaaggggcacgtgttgcacttacgctcatgaaaaaccttgggatttcatctatctatgcagtcgataagaaaaagcatttattaggtgttatttctgcacaagcggcgaaaaaggcggcagaaacgaatacgtcgctcgaaactgttcttgataaagaatttacaactgtattggagtctacgtatttaacagaaatctttgatgcagtgtctgatgcggcaaatattccaattgccgttgttgatgagaaaaacagaatgaagggtattgtggtcagaggtgcattaattggtgcgttatcaggtaatgatgagtatatcaacatgtcttctaacaagcttgaggaaattaaaacacaagagccttctgcacaggaggtagaataagatgtttagtatgagtgatttacctagaattccgttcgctgattacatcgatcaatttgttgactggttaacattaacttttggtggtttctttgatgggatcacaaatggattggcaggaactgtaaatggaattgttgcagtacttggcgtggttccatctattattttgacacttatttttgcagcgctagcttggtggatcagtacaagaggaattgctcttttcacacttattggatttttgctgatcgactatttaggctactggcagccaatgcttcaaacacttgcgctcgttttaacagctgtggtcatttctatcgtgattggggttccgatcggtatttgggcatcacagaaggaaactgtgcgtaaaattgtgacacctatcttagatttaatgcagaccatgcctgcattcgtttatctattaccagcaatcttcttctttaacattggcgttgtacctggagttgtggcatccgttattttctccatgccgccaacgattcgtatgacgattctcggtattaaacaagtaccatctgatttaattgaagcaacagaagcctttggttcaacgacattccagcgtttgttcaaagttcagcttccacttgcaacaaaaaccatcttagctggtattaaccaaagtatcatgcttgctctatcaatggtcgtcatcgcggcaatggtaggtgcaccaggacttggttcagaagtatatagtgcggtaacgcagctaaaaacaggaattggttttgaagcggggattgccattgttattgtggcaattacacttgaccgtattacacaaaacatcaaaacgaaaaaaaccagggggaatgcttaatgtggaaaaagtctctctacattgggatgaccgccctgcttgtctttttactagccgcttgtggtgcaaagtcagattcaaatgcgagtgcagcacagcaggtgaataaaaccattatcggcattgatccgggttcaggaattatggcgctcacggatcaagcaaaaaaggattacggcttagaggattggacggttgtgtctgcatcaagtgcagccatgactgcaacgctcaaaaaatcttacgaccgtaaaaagccaatcatcatcactggctggaatccacactggatgttttctcgatatgatttaaaatatttagatgatccaaagaaatcttacggtgaagcggaagagattcatacgatttcacgtaaagggtttgcaaaggatcagccggatgcagccaaaatgcttggtcagtttaaatggtctcaagatgacatgggcgaagtcatgatggatatccaagatggtatcaatccaaaggatgccgccgttaaatatgtgaaaaaacataaagaccaagtagcgaaatggacaaaaggcgtgaaaaagtcgaatggtgaaaaagtcaatcttgcctacgttgcgtgggatagtgagattgcaagtaccaatgttgctgcagaagtactgcgtgagctcggatttaaagtgaccttgactcaggtggaagcaggtccaatgtggacagcaattgcaactggaagtgcggatgcctcgttatctgcttggctgccaaatacgcataaaacgtatgcagcgaagtttaaagggaaatatgatgatctaggcacaagtatgaaaggtcttcgcatgggtctagttgttccgacatatatgaagaacgtcaactcgattgaggatttgaaaaaatagccaattatgatgaagttcccttataataggagggagcatatgaaaaagcagtctgctcaagaagcggctgcttttttcttatatataaggaaggtggacgagttgtcgatgatggttaagccaatcatgatttttctgcatggcggaggagtaagcagctggatgtggcaggaacagataaaaacattcaaggaagcgtatgaatgctatacgcctgatctcattggtcacgggacaagagcagatgaacagtcatattccatgcgagaaagtgctcttgaagtcatctcgtggatcaaggagcatacgcatggacgtaaagtgatacttattggcttctctctaggtgcacaggttgccgttgaggtgttatcaaaagagcctgacatcgtagagatagccgtcatcaacagcgcacttgtgatgccgctgccatggctttacttgatggtgagacctcttttacctcttacgtatccattattaaagaaagattggtttatcgagctccaagctgaaaagatggggcttccaaacgatgtactcaatcactatgtggctgattcgaaaagtttacagaagaaaacccttctgacgatgtttcaagaaaatctccattacaagctcccaaacacgtttcaacaagcgaaggcacgaattcttgtcacagtgggagaaaaggaaaaaggtattatgaaacggtcagcaaagaaaataacgaattcacatccgcaggcagcaggtgtcatcgttccggctatcggacatacatttacgtttgaaaagaaggaactgtttatggatatggttcaatgctttatagaggaacgtgcgttaccagtggagttaaaggaaatcaagtaaccgaaagtaaagacaggcataaaagaggcagccagatcttagaaccgatatgatagaggtataaaacgcttacagatgagctgctgtctgactgaaagctcaggagacgtagaaggaggagctatgagtaaaaactatatcatattcggtgcaagtcaaggattaggggatgcttttgtgaaaggtcttccttcaagcggagatacagtttggattgtgtctcgaagtgaacctagcagtttgaaattagatgacggtgtacatagaatttggctgaaaattgatttatcaagccaatctcatattccacacatgatcgaagcattggggaacaaaaccattgatgtcctcatctacaacgtcggtttatgggaaaaacgaggctttgaagatgattattcatttgatcacgatcagccagaggatatcgctcgtttaatcaatgtgaatgtcacctcaacgattacatacatccaagcactgcttccgcatgtcaggaaatcggagaatggaaaaattatcgtggttggctcaactgcgggactcgatcatacaaacctgccgcaagtttcttttgtcgcatctaagttcggcctgcgcggaattgtgaatgcactaagagagcatgtgagaaaagataaaatatccgtcacctgtatcaatccaggagaattggcggcagaggttccatatgaagatggagccgaaaaagccatcgctctatatgatgaaacaagaattcctgtgcaggatatagtagagcttgcgagatgtgtgattcatttatcaagggtatcttgtgtaaaagaaatcaatgtcccagccatgacagatttgaatgcataatatcaagtagaccacccgctaaaaaacgggtggtttcagcgtgtagacaaaccctcgcattcgttgtcagttctgcgtgctggtgctcacgaatgtcaaattcgctccgcgccagtactcgtccttcctagaattcaaaggttttctatcacgctgaaaaggagacaaaggactaaaataaagatcattttagccctttgtcaacaatctgagaccaccctctaaaaaaacgggtggtttttttattttatgatgaatgctgctgaagagtctgataaacagcttcagtcaaaatctcaatgccggtaaaaatagcagagcggtcgaatgtcatatatggatgatgtagaccgggctttagatcacagcctaaaccaagcatcgtggatttgatatgcggaacctttgctgcataaaagtgaaaatcctctccgcctgtcgttacgagcggaggatcaagctgctctttacctaaaaccttttcaatggcatgagacatcatctggacggcttcctcattcaaggtagcggcaggcagacgatgatcagttgaaagggtaatggaagcgccaaaggcatccgctacagaatgtacggctctttcaatttctttttctagtttatccatcacttcatttgtttgtgctctgacatctagtgtaaaagaagctttgccagggatgatgtttgaactgcctccgccagcatgtaggttggtcattttcacagaatgtgcaactcttgggtcgacatggatatgtgcgagtctttgcacgagggtagaagccacttcaatgacgttgacccctagatgcgggcgtgcaccgtgggcttcctcaccaataattgtgccgatgtaatgattactcgatccatgcaagatcgcaggtgcgcagcgtccgtttaatgtttcttgaattgggcgaacatgtactccgtataagtaatcaacgtctgctagcacacctttttcaatcattttcagcgcaccgccgcctttttcctcagcaggctgaaaaatgaagcggatggtgccgtttgggagctccttttcttttaatgccatgaaggtgccgagagccattgtcatgtgtgcatcgtgaccacatgaatgattggcttgaaattccccatctacttcctgccaaagtgcatcaatgtctgctctcaccgcgaccactggtgaaccttctccaatttcaccgatcactcctgtacagtcgtcaaatgttcgggtctgacaacctattttctttaataagtcctcaagataagccgtcgtattcgtttcttcccagctgatttctgggtgagcgtgcaggtgatcaaagatgtctttcaccgtttgctgcatgtcgtttgtcaaagttgtcatgaatagcctccttgctgacagaaaatctgtcaaaatattcttttagtgaaataatattgatcttaaatatcatcagtgtttataatataacacatcatttgattattcagaaaattaagtgaaattccgatcgggacaaaggggttttgacacatgaaaacagcagcagtatcaccaccagagaaacaaaaaagaaaacttcaaatgccagatgcgtatgttctcttatttatcattgcgctcatttgtaccattgcaacatattttgtacccgcgggtgagtttgaccgaaagacatcgggggaaatcacaacagctgttcctggcagctatcaccgcattgatcaatcacccgtaagtccagtgggcttttttacagccattcaggaagggatggtagggtcttcttctattatttttctcattctatttactggcggaaccattgccattttggagaaaacaggtgccattaacggaatgattcaccatgtcatcagcagatttcaaacaaagcaattattgtttatttgtattgttggaggattattttcagtgcttggaacgaccgggattgtcgtgaactccgttataggatttattccaatcgggattattgtggcaagatccttgaaatgggatgctgtggcaggagctgcggtcatttatattggctgttatgccgggtttaacgcgaccattttgtctccatctccactggggttatctcagacaattgcagaactgccgattttttctggcattggtcttcgtgtcattatttatctttgttttcttatatctagtattgtgtacatctatttatatacaagacgcttaaagaataaagaaaagggaagtcttcttggagatgaatggtttcctgcgaagggacttggcggatctgatgcagaatctgtggacaagcctgaatttacgagcagacataagctgattttagcagtgtgtggattgtctcttgggggcttcttatatggcgcgcttcagcttggctggaccgataaggaaatggcaggagtcttcatttttatggccattgctgctggattacttggcggattagcagccaatgatattgcaaaaacgtttatcgtcggctgtcaaagccttgtttacggcgcactcattgttgggatggcacgctgcatttctgtcattttggaaaacggtaagctgcttgataccgtggtcaatggcttggcgagtatgttgacaggatttagcccaattgctggtgcgatcgggatgtatattgcgagtgcacttcttcactttttgatttcatcaggatcaggagaagcggttgtctttattccaattcttgcgccgctggctgatttaatgggcatcacaagacaggtcgctgtagaagcggttatgcttggcgaaggggtggttaactgtatcaatccgacatcaggtgtgttgatggctgtgctcgctgcaagtggtattccttatgtgaagtggcttcgttttatggtgccgcttgcgctcatttggtttgtcattggacttgtctttatttgtatcggcgtgatgatcaactggggaccttattaacatgtataaagctgctgacaatcgtttggcagcttttttcttgtggaaatatgcatggagacagcgctttgaaagcacaataagtgtgttcacaaattcgctacatatttttttgagcaacccccttgcaaaagtttgtgaagtattgcacaataagaatgtgaaatacttcacatacaaaaaacaacctagttttactcaggaggatgagataaatgacaaacgaaaaagtaaacaaagtagcacttattggagcaggttttgtaggtagcagttatgcctttacattaataaatcaagtgatcacagatgaattggttgtcatcgatttgaatcaagataaagcaatgggtgacgtcatggatttaaaccacgggaaagcatttgctccgcacccagtgaacacatggtatggagattatgaggattgtaaggatgcagacattgtatgtatctgtgctggagcgaatcaaaagccaggtgaaacgagacttgaccttgttgagaaaaatttaaatatatttaaaggcattgtagacaatgtgatgaaaagtggattcgatggtattttcttagtcgccacaaaccctgttgatattttaacatatgcgacttggaaattcagtggactgccaaaagaacgagtgattggcagtggaactacacttgatactgcaagatttagatacatgctcagtgagtactttgacgcagcggcacacaatgtgcatgcgtacatcattggagagcatggcgatacagagcttgctgtttggagtcatgcgaatatcggaagtgtaccgattacagaattaatgaagaaaaatgatcaatacaaacaagaagatttagatgagatgatggaaaatgtccgtcatgccgcttatcaaatcattgagaagaaaggcgctacttactacggcgtagcgatgagtttggcccgcataacaagagcgattctgcacaatgaaaacagtattttgactgtcagcacttacttagatggggagtacggagcagaagatgtctacattggtgtacctgcccttgtgaatcgaaatggcgcaacagaagtgatagagcttgcactgaatgatacagaaaaagaacaattcgcgcacagtgtgaatgtgttaaaagagattttggctcctcatttttaatcaaaagcaacctatctgagcagaaaaggatgaatcactatgtggcagcaaatatataatccgtttggtaatgagttcgtgagtgcattggtagcaatgcttccaattttgtttttcctacttgcattaaccgtatttaagttaaaaggtgttttagccgcttgttttaccttaatcgtcagttttgtaacagcagttttcttctttcatatgccaattgaaaaagcattatctgctgtgctgctcggtatatctaatgggctgtggccgattggatatatcgtcatcatggcggtgtggctctataaaatagctgtgaaatctggtaaattcgatgttattcgttctagtattgcaggaatttctcaagatcaacgtcttcagctcttattaattggttttagttttaacgcatttttagagggagccgctgggtttggtgtaccgattgcgattagtgccgctctcttaacagagcttgggtttaaaccgctgaaagctgcgatgctctgcttaattgccaatgctgcatctggcgcatttggtgcggtgggtatcccagtcattacaggggcgcaaatgggcaatatgacgccgcttgcattatctcaaacccttgtgtttacgattccgtttatttcattctgtattccgttcctactcattctcattgtggacggattcaaagggattaaagaaacgctccctgccttgcttgttgtgagtggaagttatgccattttacaagctgtcacaatggtgacaatgggtcctgagcttgccaatattatttcagcattagcaagtatggggattttggctttatttcttcgaaaatggcagccgaaacatatttatcgtgaagaaggagcaccagccattgaacagaaacaaacgtatcgcggcgttgaagtgctaaaagcttggtctccgttttatattttaactgccgtgattacggtatggagtctgccagcatttaaagcattgtttgctgtaggaggcccgctcaactggacaaccattttagtgaaaatgccatttttgcatcagcaaattgtgaaattaccaccaattgcacaaacagcaacacctattgatgcgatctttaaaatagatgtgatcagtgcaacgggtactgccattctgattgcagtgatgctgactggtttgtttagcagacatattacattaacagaaggcgctgcctgcttaaaagcatcagtgaaagagctttgggtaccagttctcaccatttgttttgtcatgggctttgccaacttggcgaacttcgctggtctaagttcagccattgggcttgcacttgccaaaacaggcgatttgttcccgcttgtcagcccagtgcttggctggatcggggtgtttattacaggatctgtcgtgagtaacaacgccttattcggcaaccttcaagcggtcactgcttctcaaatcggctcacaggcaggtttgttaattggagcaaatacaacgggcggggtcatggcgaaattaatctctccacaatctatcgccattgctacagcagcagttggagaaacaggtaaagaatctgagctcttccaaaagactgtgaagtacagcttcatcctgctcggcatagtgtgtatatggacattcattcttgctcaatttgtataggtttaaaaaagactgagacagctctcagtctttttttgtttatgtcgattcccttgtcacgagccgggtaggcagctggatatgctcacgctgtaatggtttttggtcttgcaggagctcaatcagttgctgcacagaccggtggccaagctctacgatcgggatgtcaattgtggtgatcgttggagctgtcacctcgcaaatgtcttgattgtcatagccgatcaccgctagatccttaggaatgtgataaccatatgaaatggcctgtttaatgagccctgctgcgacttgatcattaccggtgaaaatggcatcaggtgcattcttcatgtcatggatgacatccattaagcgaaaaccgtcttcaatggtgaaggcctccccgaacagccaatcgtcatgaagcggcaagccgtgggcagaaagagcatcgagatagccctgtttcctttgtttctgtgcttcactgctttctgtatcaaagcaaaacccgatcttttttcgccccgactgaatcaagtagtcaactgctttataggcagcttctcgctcatcgtatccaataatcggaatgtctgctgtttgatgatattcattcgccatgacaatagggccgttcgttaaaaatggctcgatcttttcccacggattttctaatgcccctaaaatgaccccatctacttctcttctttttaataattgaagaccttcaagctctaacgactcctgataaaacgtctgaagcacgatcgctttataaccttgatccagtgcttcttttgaaatgcctttaatcaattgtgcaaaaaaaggatggtccacagccggcacagacacagcaatggtttttgtctgatgtgaacgtagagtgcgagctgctgaactcggtgtatattccatttctttcatcacctgtaaaatgagctggcgcttttcctctgacacatatggatgatgattcagcactctggaaacggtggtggttgaaaccccgcagcgtttggcaatttcataaattgtacacatattaacaaatcctttacacaaagttattgttctgaaatcgataacatcatttacaatgtgaaacaagttaaatattaacaaatggaattgattaattggagggaatggaatgcaaatattgacgaagatatcaggtaaaagcaaggattatctccctttgctggatatgatcaatcaaggtgttcaagtaaagtctgattcagttgagaagcacctagcaaatgaaaagctggtgacgttcctcgaacaagatataaggcgcactggcttggaaaaaattctcttccattataaacaaaataaggaaaaaaagataccgtttctgccagtcgataaactgatttcagaggatgagatcgatgacattatgcaggtactgaaagaagtattgagttccggccgttttacttcaggaccatatattccggcgtttgaaaagcagctcgctgagtacttagggaagaaatatgtcattgccacgtcaagtggaacagacgccctaatgatcagtctcatatcagcaggagtccatccaggagatgaggtcattttgccagcaaatagctttgctgcaacagaaaatgcagtgcttgcgattggggctgttccggtctacgccgatattgatccagatacttactgcttggcaccgagtgaaatagagaagcatatcacagatcaaacggcatgcattcttccggttcatttatatggaaaacaagcggatatgaaggccatttcggcgattgcgaaaaagcatgggctgaaaatcattgaagatggctgtcaggcaatcgggagcactggcctcggagcatatggagatgggcttgttctcagctttaatccatacaaaaatcttggtgtctgcggtaaggcaggagccattgcaacaaatgatgaagccctagcggagaaatgcatggagatcagctatcacggctttgaagtaggaaagaaaaatgtcaaacgcagtgactatggctttaattcgaaaattgataatttgcaggcagcgatcggactcgaacgtatgaagtatttaggattacaaaactttaaacgtttctacttagcaaagcgctacattgaccagctgcaaacgctagaggatgaaggatacttgaagcttccgaagctgacggatgatcatgtctggcatctgttcccgatcagggtgctgaagggagaacgagatgagcttgcagcgaaattgctggaaatgggcatagagacagatgtttattacccaatcctatcgcatcagcatcaaacagatcttgtttctcaaaagtataaacgtacatcacttccacatacggaaaaagcagcacagcaattacttcacttgccgctgtatccaggcatgccgctgcaagatcaggagaaggtcatcgagggggttcaacatgttatcaagtcttccattcaataaaaaactactgaatcagccgaaaaatccgaagtggatcgtcttctgtgattttgatgaaacctattattctcacgaaatgacagaggagcagcgagaggatgtcaagcggctggaggcctttgtggcagaaaagagcgaagcaggagagcttatgcttggctgggtgacgggaagtagccttgattctgtgacaagcaaaatggaaaaaggcggttttcatcaattcccacatttcattgcatcgaacttagggactgagattgtgtatacatcagatgctcattttggacagccagatgcggagtggatgaagcgtctggatgcacagggcttttcagatgaaaaaattgaagacatcctcgaaaccatacgtgaaaagggaattcatctcagaccgcaaacgcagctgggcagctcagggtataagaagaatttctattatcaggagcaggatgagcggacagatcttcatcatctatcattcatccaaacacttgccaaagagcgcggggtggcggtcaacatcaacaaatgcaatccgctcgcaggagaccctgcggattgctatgatgtcgattttttaccagtcggcacagggaaggatgaaattgtccgctttatgctgaaacaatatgatttatcgaaaggtcaaggctttgcctttggagatagtgggaacgatttgcggatgcttcaatccgtcacgcacggtttcctcgtccaaaatgcgacggccgaagccaagcggcaccatcatcaaatttgtcatcatgggtatgcaaaaggaatctatgaaacactgaaaacagtgatgtataaacatgaggaggcacattcatgaagaaaattggaattgttggagcagggaatattgcaaaagcacatgcaagagcattgtcaacgatcaaaggtgcagagttatcaggtgtctatgatttacacgagtcagttgcacagggattcattaaacagtatggcggacgtgtgtattcaagtatcgaaactttagcagatgcatctgatgggttgatcattgcttccccgaatttttgtcacaaagaccatgcccttcaagcactaagagcaggacagcccattttatgtgaaaagccgatggctgtgtcgctgaaggaagcgaaggaaatggtggagacagccaaacagttccaggttcaagccagtatgggctttaactatcgttacttatcctttgtgaatattttgaagaacttgattgccaatggtgaattaggccggattttaactgtcaggactcattttaagaaaaacagtgccctcagaagaaagacattttcatggagagacagcggggagagtctgcgtacgagcggtgcattaggagatcttggcattcatttaattgatatgctttggtacttatttggcagtgacatgaagaaagactccttaaataccaagatgctgacgcatgtaaaggaaaaggaagagaaaaaggtacaggtggatgatcataccgaaattttcggtcagatggagaatcaagtgttctttcatttggtcacatccaaaagcacgcagccggaggaatgcggatttagtgtagaagtcgttggtcatgacaaggtattcaaatatcatacgaacatgaaaaacgaatatgagatcagcgatggcttgtgtgtggagcgtcatcaaatgccgcaaaccctgctgacagatccgccaaatgaattttacggatggtctgatacgttccgtgatcagctgatgcactgggtgaatacagatccatatccatctcatatgaaagttgctgattttgtagacgggtatcgcgcacaggctgcgcttaatacatgcttcgagagggaagaggctgtcgagtctgctcgggcatattaaagaggtggagcggaggatgtcaaaactccgctcctttttagaggaagtgaaaagatgaaaaaagtattttattttggctgtgtcttttatttttttattgggaccattcatgtgttttttggcagtttaactccttatttactgtctagttacgataagggtccaggggaattatcatctttaattttttttcagtttattggttttttgacaggggttctgttatcccccatccttgtgaggaaaaaaggctatggcgctgttctgactatgggtcttttgctgatgattgggtcacttctgcttgggcttttggtgccgggctggtcaacacttgtgcttgcaggtttttttcttgggagtggtgcaggcagtcttgagacaacggccggagcgtatgtgatttcgatggcaaacagtgcaaagcgaatcagcatcatggaggtcttctttgggttaggagcgctgttatttccacttgtgattttactgactgtcaatgaacagacgtggcactatgtgtttttatttcaagtcggtgcactgactttcttccttatgctctggcttgcctttatgaacaaattgcctcgtggacagatgacttctccttccaatgggggaagaaaaccgtccttacttgttgatcgaaacaatcgaatcattgtggtaatcatgatttgctttgcctttttctacgcagggattgaaacgaactttgcgaactttttgccgtcgatcatgctggagaaggggggagacaattggggtctctttgcagtctccactttctggacagccattgtcatcggcagaaccgtgattgcgagaaaagcagaccagctgcacccgctgcgttttttaaagctaagcgcagcactcatgattctgctgctcgtggtctttgctttgaccacccacattgccgctcagctgctcctcatctttttcattggcttgtgcgcagctggtatgttcccaatcgcactgactgcatctgcattaatgattgaaaatgccatcgacgaggccacgagttactttattgcagccgcaagtttaggcggagcctgtttgtccttcttgatcggctttagtcttgaatgggcaggagcagcaagtgccatctttgttttcgccttcttagctgttcttctatttgcagctgcgattcaaatgaatcgtatgaagaaaaaagaaaccgttctcccgcagcagtcggcactgaaagcggatcgataagcgatatcaatgcccttgagtccgcctgaaaagatgacaaaggacttgtactaaaccatagaacgtttgaataatatgtacaagtcagcatcaaaaggaggacgtctatgtggcggtgttttttgggtatatctttttagggttgtcactttcagcgcctgttgggccagtgaatgctgcccaaattgatagagggattaaaagtggcttttggcatgcgtggatttttggtgtgggggcaatggctgcggatattgtctacatgctcctcatctattttggtgtcgcccagcttttgactgcacctcttgtgaaaacctttttgtggctgttcggttttttcgttctaacctataccggaattgaaagccttcgtaaaatcaacttgcaggaaagtccaaagaaggatggaggaaacacgtcgatcgggcattcgttcatgacgggatttttcatttctctttccaatccgctcagtattttattttggcttgggatctacggcagtattttggccaatacgatcgaaaagtatggggcatctcaaatgctgatgtacagcatagctatttttatcggcatgttaatctgggatttcagcatggcgctgttggctagttcgtttaggcgctatttaagtgaacgtgtcttacatggcttatccgttcttgcaggcttatctttacttggtttcggcgtctattttgggtatcaagggatcatggcgttgatcgggtagaaaagcagactgacatgtcagtctgctttttttgtaaggattgacagacataacacattcttgaataatggtgagatataaaatggattcaaggagctttgccatgcgtatttttcttccagtcttcaactatttgtgcatgctgatcttatcagtcatcacagcaacattcgtatataccctgctatttatcccgcctgaagcaggctttggttatgtggagatgacaagtctgctcattttgattgcttatgtagtgtttgctacaccgattcagcttgttttacacaggcatcctagaaagtttcgaggccgtgacttacttgtttattttcttgcggcgtgggtgatttgctctgcgttagcgttatggattgattatggactggttgtgttcattagctacaaagtctatctgttttgcttttgctcagccctcatttattgggtgctcgattctgtctttttaatgaagaaccgatcatagggttgatacaaaagtgctctatgaaaagaagcagcatggcgtgaaaggcacacatacatgctcaatttgaacgagaacatccacctcttgaatgcgcaatgaaagtcgcttagggacagtcaccacagcctttttttctcataggctatggagaagacgctaaaacgaggtggaaggaaatggcccagttgtatgcaaaaagttgccttgatcaaaatctacgatcactagaagaatggaagcaggatgcttttacgctatttggagagatggtaggagatgaggcagatacattcccttgtgtccccggaagacagggattttttctcgatcatttacgctatgggtttgtgggtgatccgagggaagaggaggctgttgaggaattagcgcagctgctgagagaatatcaaagctgtgcgaaagaaacgggtcaatatgcttcatttatttgtttttttgaaacaccacaggatttaaaggaaagttcgattgaagagtttgagcagcagttttggtcattgcttcaacgactgcaccagaaagatgaagtgccatggcctgaggagattccactagatgctcatcatcatgagtgggagtattgctttcacggggaagcatattttattttatgctccacaccggctcataagctcagaaaaagccgccacttcccttatgtcttaatggcatttcagcctagatgggtgtttgataaattgaatggatcgaccaagtttggtcaaaaaatgagccagctcgttcgcaagcggctcaaagcgtatgatgaggtcggtgttcacccatcattaaaatggtatggtgatccgatcaatcatgaatggaagcaatactttctcccagatgaagaggcggagaaaccagcctccgccaaatgtccttttactgcattaagaaacatgatgaaattatgatgcggtctgatcttgctgcttccactttttcctcataaatagcaccatgatggcaatcactgcaatgatcccaaggctgataaaaaagccaggtcgtccgcttgcctctgttaaagtgcctgaaatggcggctccaatcaagagaagcgcaagaaacatttcgcacgtttggcgagtggatggctttgatagttttttacttgagaacagaatgaagacccatgtgtacagaagggtaagaccggctgctgttgtgagatgctcgtagatgtgtttggacaaaaagagtgcaagcaaaatcgagacaattaatccagcagcagttaaaataatcgaaggccatccgacatgagaagggtctttttgtttaaaacaagcaggtgcatcttgatgctccgacatcgtgccaagcagcgtcgtgactgcatagagtgaggcaaccaatgtcgaaaagccggcaataatgaaaatgccattaaagatatgaagaaagatcgataaatgaaatggatctaatgatgtaataaatggactgctgttctcgttaaaggctgttactgggacaagcaagagagcaagtccgatcgagacgatatagatgaccgctagaatcatcagcatgacccgtccagactttgctgcatccttcgggtcttttaaatgaaccgccatcagccccatgacctcaattcccccaaatgcataaaacgcgtaaatcaatccattccaaagaccaagtgcaccgagcggcatccattcgtgatctttgtttggcagatgcagggtcggtttatgatctgtcagaatgccgaataacaccagaactgccaggatcataaatagaaaaatcgccgctgtcttcagtactgctaggacattttctgtcttttgaaaagaagagagccctatgattatcacgagcagggcaagagcggaataaatggcagaaaacacccagagcggcacagatggaaaccagtggcgggtaaaaagagaaatcgctgttaactggcttcccgtaatcagcatttctgcaaaccaatacacccagccattgctaaaccctgcccagcgtccatatgctttacgagcataggagcaaaacgaccctttatcagggttatcagctgtcatcgcagccaaatgtttaaagacgagataggttccaaccgcagcaagtaaaaaagaaatgcagacggaaaaacctgactttgtaatggcaatgctggaaccaaggaagaaaccagtgccaatcgtacagccgactccgatgagagaaagctgccaccaagataaagtttgttcttctttcaatgcatgcgcaacacctttctgtttcaatgacattagcttgtgaccgcctcttttttttatacatgatcaagaaagaggacgttttgggcatactgtcaaggaaaggagtgcatgtgatgaacggagaacatgtcattttaccaaagggcagactcggctttcgtttaggaaaaggccaatgtatgcgggtggttgatgttgaaggtcagcaagtagcagatgtgatggcttatcacgaaaaggatttttatgaaaaatttgaccaaggcgcgacaatggacagcctattttcatcaaaagtgaaaaaaggcgataaactctattctaacttatacaaaccgatgtttacgatcattgaagactcagtcgaatgccatgatttatacatgcccgcctgccggcaagaaatgtatcagcttttatatggacggacgcatttagaggtcatgcatacatgctacgataatttgcggaatgcctttaaaccatttgggattccgaaggaggatatgtactacccttttaatgcctttatgaatacagtcattgatgaaaaaggaaagctgtctgtggagctgccaaaatctcttcccggtgattatattcgtctgcgagccgaaatggatctcattgtggccgtatccgcatgtcctgctgatattgggaagtgtaatggtgcaaactgtacatcgatacgggtagaaattgattgaaaaagaaaagggccagtccatatagacatggtctttttcatttatgaatgtttgatcatgaatgaaataggggaacgtctaacaaaatgttcttcctgaaaacatggtataatgaagattcaaaaaacgttgtcaaatcaatgaattcagagtaaaacctgttctcttcatgtagaggatgcttaggaggaaaagtgtatgagtttgcaaaaaaagatcagccaagagttgcatgtgcagccctcaattgacccaaagcaggagattgaaaaacgggttggatttctaaaggactacttgaaaaaaaccggtgcgaaaggattcgttctcggcattagcggcggacaggattcaacgctcgctggccgtcttgcacagctcgctgcatctgaactgcgtcaagaaggaaaagaagacgcagtctttattgcggtgcgtctcccgcatggtgtgcagcaggatgaagatgatgcacagctcgctttatcatttattcagccggacaagtcgtggaaatatgatattgcgcctgctgtgaaggcattcagtgaacaatatcaaaaagacatgggcggaccgttgtctgactttaataaagggaatgttaaagcgcgcatgagaatgatcgcacagtatgctgtcggaggagaagaagggttacttgtcattggtacagatcatgcagccgaagcagtcactggattcttcacgaagtatggtgacggcggtgcagacgttctcccgctcacaggtctgacgaaacgccaaggccggatgctgctagaagcgctgcaagcaccagagcgcctatacttaaagaaaccaacagccgatctgcttgatgataaacctcagcaaacggatgaaacagaactaggcattacgtacaatgaaattgatgattacttagaaggtaagcccgtgtcagaacaagcagcagaagcgattgaaaagcgctatgttcaatcagagcataaacgccaagtacccgcttccatgtttgatgactggtggaaataaaaaaaagacctctccagaagatggagaggtctttttatgtcgaatttcaaatgggtttgacaaaataaccaaaaattcattaaattagtagaacgatatacttaagtctaattcactaaatatagatttatttgaaaggaaaatgcattcatcattagttcgattcacttaatttcactgccattgacagtattttcagaaaaaatgattgacgaagaaaaagaatgcgcttacaatgaaaacacattccgaaaagtgaaattagattccactgtatggaataaaggggtggttcactccaaataagaagctaaaggaatgattgacacaatgaaaaatcgaagtgcactggaaatttacaaagagggaggcgcttggtgggaaactgagattagtcatattcaaaaaaactcaattgaacttcgaggttatccgattgaagaactgattggtgaactgtcgtatccacaaatgctttatttactgcttgtaggtgaattattggatgattcaaaagcagctctttttgaaagtgttcttgtcgcaggtgcggaccatggaccaagagcgccatctattgcagcagccagaatggcggtgacttgcggcatttcgtttaattcatctgttgcaacaggggtgaatctattaggtgatattcatggcggagccggtgagaaggccatgcgtatgttatacgaagccaaagcgatctacgatgatcaaaaggatatacagtctgcggccaagcaagtatgtcacacatggttaactcgcaaggaaaaaattccgggaatcggccatcagcttcatgatgatgatccgagggtgagacgtctatatgagctgagtcacacatatgtccagcaaggtcttatcagtgggatatatttacggttagccgaagcgattagacatgagcttgaacacctgaaagggaagaaaatcacgatgaatatagatggtgtatctgctgccatccaatgtgaattaaacattccagcagaagcagcaaaaggcattttttccttatccagaggaatgggcatcgtggcgcatgcatatgaggagctgacaaagggagccctcgtgaaaggaccttgtccgaatgaagaaagattggttcgttatgcaggacatggaacgcggcacttgaaggagggagagaaaatttgagctatttgaaagcgttatcatatataaacggcgagtggctggataccggtcgtgtgaaaacagatatcacaaatccttactcaggagaaaggataggtacatcatatctcgcctcaccaaaagacatagaacaagcactttctattgcgcagcaggctaaaaaacaaatagcgggaatatcggcaattgaacgctcaaagattctaacaaaagcaaccgccttgcttgaagaacaaaaagagcattttgcaaaactgatttcgttagaattaggcaaaccgcttaaaaatacaagagatgaagtctcacgatcaattgagacgctggcgcaatcggcggaagaagcgaatcgattaataggtgagaccattcctggcaatgtatcatcgcgtggacagggagcaatggccatgacatttaaagtaccagtcggagttgtgctggcgattactccttttaatgcacctctcaatttaatttgtcacaaagttggcccggcttttgcgggagggaatgtcattattttgaagcctgcaccgcaaacttcagctgttgctacagcgtttgtcaaactccttctcgaagcagggtttcctgaggtaagtttgcagcttgtgattggcggggtcgacgcggggaaacagttagttattgatgaaagaacaaatctcatctcttttaccggcggggctgccggaggagaacatattacaacttctgcgggattaaaaaaagtattgctcgaactcggagggaatggcgcgacgattgttcatcacgatgctgatattgaacaagccgcatccctttgtgccaagacaggctttagtaattctggtcaaagctgtatttctgtccaaagaatttatgtccaccaggaaattatgccgtcgtttactgaggtattaaaacaaaaagtagatcagcttgtcgttggagatccgttgtccagtgagagtgatatcggctgtatggtcgatgtacaggccgcgcagcgagttgaggcatggatacaagaggcagagagtatgggggcaaagcttttatgtgggggaaaaagaaatggagcgagcatcacaccggctattttgctaaaccctccgaaacaggccaaggtcgtctgtgaggaagtgtttggcccagttgtcagcattctcccttatgcggagctggaagaggcaattaaagaagcaaatgatagtcgatatggtttgcaggcagggatctttacgaatcagctggatgtggcgttacacgcagcaaaagagcttgaaactggcggggttgtcatcaatgggacatcgaattttagactggatcattggccttatggtgggattaagcgaagcggtcttggaagagaaggtccgcgtttcgccatcgaggagatgaccgaaaccaaaatggtcgtgcttccacagggtctgtgaaaggggcgtttggatgtgaatgcatttcagcaaaaggtaaaaagtgtgcagacaggcgctcagccaatgatttgtacgccgctcatcggacaaacaaaggaagaattgtttcatgaggtcgaggtattaactgagaaaaagccagatgtgatagagtggcgggcggatttttttcatcaccttcatgacaaggaacaagtgatagaaacccttaagggaatggtagaaagggcaaagggcatcccatttttattcaccattcgttctgaaaaggagggcggcgaaagtatatcactctcggaatctgagaaggtttctttgcttgccgagctttgttccactcagcttgtggacgccgttgattatgaattgatgcatgatgtgacatatatacagcaagtcagtcaggcggctaaaagaaatggggttaccttgattgtgtcgtatcacgatttccagcgtacccctgaggtagatcgtctcatgcagctattcgtcaatgcagaatcagccggcgccgacatcgcaaagatcgcagtgatgccgcattcctatgacgatgcattaacactgctctcagcgaccagccatgcgaaaaagcagctgtcaattcccgttatttcgatggcaatgggggaatacggggcttttacaagaatgattggcggactttttggatctgtcatgacctttgctgtagggaaagaaagctcagctcccgggcaagtggcgatacaggatttgaacaccgttctatctattgtttttcaaagaataagtgagtagcagattcatagctgcaccgtgagaggagagaaacatgaagaagaatatttctacacaggttattcagtacttagaaaatcggggagtcgagcatatttttggtctctgcggtcatacgaatattgcctttttatcagcgcttgaaaaaagctcgattcaatttgtaaatgtcaggcatgaacagatagcggcacatgcagcagatggttatgcgcgagcaaagaaacagacggctgttgtgctcagtcatctaggtcctggactcaccaatgcggcaacaggggtagcgaatgcagcacttgattccattccaatggttgttattgcaggcgatgtcccaagtcattactacggaaagcacccacatcaagagatcaatcttcattccgatgcctctcaatacgaaatttaccggccgtttgtgaaaagagcatggagagtcgatattccagcattatttccagagattttatcaaaagcatttcagttagctgaaagcggccgtcctggtccagtgctgatatctgttccaatggatgtgttctcaaaggacctagatgtgtccttgtttgaacaaatcaaccatcatacacagaccattgaaaaaccttcaattgatgatcaaacagccaatcggatattagatcgattgctgcaggcagaaaaaccgctcttatatgtagggggaggcattttactagctgatgcagctgaagaattaaaggcattttctgaccatctcagtatccctgtcgcccattctttgatggggaaaggagccatgccggatgatcacccaatgacccttggaatgacaggattttgggggacaaaatttatcaatgatcagtgcaaagcggcggactatatattggctttaggcacccgttttgctgaagctgatgcgagttcatgggaatcagattatacgttccgtttcccgtcaaccaagctcattcatattgacattgatccgaatgaaattggacgtaactatcctgttgacattggagcagtagccgatcttaagcaggccttgattgtactcaatcgagtggcgagagaaagattgccagaagggctgaatcgacctgaattgaaaaaggaaattgcggcatatcgtaaggattttcaggcgggcaacctgacgaacactcaagatgaatctttcccaatgaagccgcagcgtattttgcaggaagtgcgggaagtattgccgccagatgcctttattacaacggatgttggctggaataaaaatggcgtaggacagcaatttcctgtgctcacgccagggaccattctaactccgggaggctttgcaacgatgggatttggagcccctgctgcgcttggggcaaagattgcccagcctgaccgtgtcgttgtgtcactcgttggggacggcggattcggtcaaaatccatctgttctcgcaacagccgttgaagagaacattcctgttgtgtggattgtaatgaataacagtgcatttggaacaatagccggcttgcaaatggcgcactatgaaacgacgtacggtacagttttcagaaaaggtggagaaagctattctccggattttgcagccattgcaagaggttatggaatgaaggggattaaaatcacctctgcttctgaattcaaagaagctttagctgaagccattgcatctcaagagccttgcgtcatcgatgtagcaatgaaaaatgatcctgtccctacggatggacattggaatattaatgatatttattcaccaaattcaaagcgctcacatgtcagcgtgaattaaacataacgaggaggaatgaacaatgaaaattaaagtattaaatccgtttcaagatgggaacccattatggttaggtttagatcatccagaggagcaaatgattcggaaggtatttcaaaccattacaccagatactgttgggtcagagcatatgatggcgggtctcaccatttttgaaccgggagaagcaagttcagtgcacaatcacccgggttcagaggaatttgattatgtgattaaaggatctggtgaagtcatttgtgatggagaaaggcagtcctttaaacaaaatgatttcatgttcattccagatggtgtctcgcatcagcatgtaaatacaggagatgaacctttatggctcatttggctttacacaccgcaagggcagcttccgaaggattaaaaaaactgcaccggtaagccctccttttgaactatcagggccttccgagtcaatcagaaagatgaaaagggctaaaatagaaagttatttagcccttcatcatttgaatgaaagggagtcaagcaatgaatatgaatacaccgctcgaaggaatgaaaatattagacgtctctacgatgatcgctgcaccctatggcgcggtgcttctaggggattttggtgcagaggtcatcaaagtcgagattcctggtaaaggcgatacgctgcggcatgttggcccttttgcagaaggcgaaccacttagatggtcaggtctctcacggaataagaaatctctcacactcgatctgcacaaagacgaagcaaaagacatttttaaaaagcttgcaggtcaggtcgatgtgttgattgaaaatttccgccctggaacactcgaaaaatggggcgtaggatacgatgtattaaaagaaatcaaccctcaattaattatgattcgtgtttcgggttatggacaaacgggcccgtttaaggacaaggccggatttggaacacctgcgacggcgtttagcggctttacatatattcaagggtttccagaccggcatccagtcagtccttccttttctttaactgattatattgcaggcatatatgtggcgtttgctaccgtgacagcgatgtattacagagatacacatccagaaggaactgggcaaatggtggatttggccctctatgaatctgtgtttcgtatgttagaatttttggttgcagaatatgacaagcttgggaaggtgcgtgagcgttcaccggggctaagcggtcattcaagccctgccggcacctatgagacaaaggatgggcactatttggttcttgtgacgagtaccgattcgaccttcaatcgattggcagaggcgatgaatcgattagatttattagagaatgaaaaattcgcggtcaatgcatctaggctgaagcataacaaagagatggatgcgatcgtctctcaatggatcgcgtcgaaaacaagggatgacgtattagaaattctagatactcatggcgttcctgtgagcccaattttaagtattcaggatatttttgagcatccgcaatttaaagcacgagagaatatcgtcgaggtacatcatcctcgtcttggaaaagtaaaggtgcctgggatcattccaaagtttgaaaaaacacccggaagtatccgtcacattgcacctgatttaggcgaacataattttgagattttaacaaatatgcttggcttaacagaagaagagtgcaaacgattggaagaaaaaggggttatttaaggcgctcaaccgaaccgcacgctgcggaaacaaaggaggatggttatgaaagtgcattcagaactgaaggggaatgaattgcagcccgcttatatgaagccaacgaaagcccgttttggcatattgattctgttgttttttattaccgccattaattatattgatcgagccagtgtatccattgttgcacctgctattcaatcttcattgcaattaaatcctgccttattaggcctgatcttttcagcatttagctggacatatacagcgatgcaaataccaggcggctttattctcgataaatttggctcaaaggtaacgtatgggatatcactcattacttggtctattttcacaggcctgcaggcgtttgcgaacagctttgcctttttattcggctgtcgtttgtttattgggattacagaatctcccgcatttcctgcgaataaccgcattgtcaccacatggtttccaaggcgggaacgggcttttgcaacaggtgtttatactgctggagagtatgtgggtcttgcatttgcgacacctcttcttttttggatcatgacgactttcgattggagaaccgtctttattacagcaggtgcgctcggtattatatttgctttcttttggtacaagtattatcacgaaccgaaagagcatccaaaggtgaatgaagatgagttagaattcatccggcaaggcgaagggctgacagtcgcatcacaggagaaactgaaatgggcagactttgccgcccttctaaaatatcgtaaattgattgggctctatattggtcaattctctgttgcgtctacactttttttctttttaacatggtttccgacctatttagcagaggcgaaaaatatggcgtttcttaaggtaggttttgctgcttctcttccttatattgctgcattctttggggtcttgtttggaggttatgtgtctgactggctgcttaaaaagggcgtatcagtgaatgtagcgaggaagctgccggtagtggttggcttgcttctgacgagtaccattgttttagcaaactttacaacgaatatcccgcttgtgctgaccattttatccatcgcttcatttgcacaaggactgtctaatatctcttggacgatgctgtctgaagtggcaccaagggaaatggttgggctggctggcggtgtatttaatttttttgctaatttatctgggatcatcactccgcttattatcggattcatcgtgtcggcgacaggctcttacaacggggggattttattcgtcagtttagtcgcattaggaggggcattgtcgtacatttttatcgtagggaaaatagaacgtattcaattaaaaccagagtgagaaagcaaaagagaactcaaaccaaggtgagttctcttttttatgaataaaaaagaacggtgatgatcgttgcacatgcgatacccatgctgatataaaagccagcaaaccatatattccagcgtgtgatacggtaagggttgaccttcatcaaatcagctaacagggagacagaaacattaaaaggactaaacatgacagttgatgttccagcaacgatcagcatgatggcaataggaagagcaggcagttcttggatgacaggtgccatcatgctgactaacaaagcaagcgaaacgagcgggtgaaaaccgcaaagagcggtgatcagaaaatataacccaatgacacaataaaccaaaatggtatggtctgatatactgacaataaatgcttgaatcggctgcatactgtttgtggcaagcagcatatcgacaaagaagccagcacttaaaaatagacacatatagttggagagctgacgggttctttctttccaatgagggacagagacggctatatattgttttctttttttgatgacagaagagaataatagagcaaatggaataatggtcagcacaacagcgaataaatagcctttcccaatccatgcatcgacaagtgagacggctgtcataaaactcagcagcatgaaagcaagctgaagggtttttcgcttaattcgacgaggattggagtttgtttctgcggactgaatgatgtttgggaatcgtttgctttgacgagaaaagagcagccaatctgtcgccagcacgatgaccattaaaccaaaagtaacaggtgcaatttgataatatttgagtttggttgcatcaatggtgacgcttacgagcacttcaacaggactccagcttaaacataatgcatatgaccttaaaaggttgcgtgtataaagatgttgtttcacttgttcttttagggattcgagcgacggtttgagcgatgtatatagtaagggaatcgtcgcgatatttaaaaacatgccaagaatatgagtgacaaatgaactcttgcgatatagctggtttgtgtttgttgtatgtagtgtaagcagtttatttaattgtgtatcgaaatgtccaacatgtatgagagaatgaataaaaggcagcatgaaaaatagagaaagcaagcctagcatggaatgaaagtgaagaaaaaaagtgtgcaatggctggtcggataaaaagaataagaacaagccaatcatgagaaacataccacctgttttcaaataaagcccacttgctttcttaaaagaaatggtgagcgaagcagcagccagcagaccaacaaaataggagagtatggcagcgggaaatagctgatgaacaatagataagctaatcagaagtgtaaaaacgagcaggtacattcaaatgccacctccatcaaatcttcaattgattttattccgtctgacggaatttgttttctcatagtggaacgtttaaaatggattatagcaaaatcgatcgtttatgtcgataagaaatcaaaggggaaaaggagaaagtgaacatggctgataagaagtcaaaagaagaatcaggactgcgtacggttcagcgcgctttggatattctttattgttttagtgaagaacggcaagagctgacgctaacggatatttcaaaagagatgaatttagcaatgtctactacaacgagactgctcaaagcacttgaaatgaatcattttgtggaaaagaatccagacacaatgaaatataggttgggtcaaagactttatctccttggatacattgcggggaagtccattaaattgagagaactggctaaaccactcatgtacgcacttcgtgatgaaacaaaagaaaccgtcaacctgtatgtactggatgcaacaagcagggtttgtattgaacaagcggaagggctgcaatcgattcggcatcttgtcaaaattggtgagaagctgccattgtacgcaggtgcaggcggaaaggtattattggcatttcaaagtgaagaatttcaacaaaaagtattagcgtctgaggctgatcatgtgatgagagatgactggcaaaaggaatgtaaacatattcttgacacgtatacttcttgcagcatcgatgaacgagaggtaggctctgcggcagtagcggcaccagtctttaacattcatggggaagtgaaggcttgtttatccatatctggtccaacccaccggtttactgaagaagtcattcccaagctgcagcaaaaagtgaaagaacaggcacagaggctttctgaacagctcggctacgtcgtcaaacacaatttttaagattgcctatcttttcccgctctttttatcatataatagaaacattatgtagcattccttgtcgtaaggaggacgtgtcacgatcatgaaaatcaatagagaaatccctgtaagacagcggaatattgttctcattggctttatgggtgttgggaaaacaaccattggtcagctagttgccaaaaagctatatcgagattttattgatgtcgatcaggagattgagaaaaaatacaacatgacgattccagagatgtttcagcaaaaaggagaagcattctttagacaggctgaaaaggattatatcgtcgatttatgcgaacatacacagcttaagatcgtctcacttggaggcggtgcattcaaacaggaagaaatcaaacgtgcctgcttgaagcattgtacggttcttttccttgacctttcttgggagaattggaagcagcggcttgatattttaattgaaaaccgtcctgttcttcacaaccggtcgcttgatgaaatgaaagagttgtttgaagaacgccgtgagatatattctcttcataactccagagtggaaacagatcatttagaggctgaggaagtcgccaattatattgtggacacactcaagcttggctgggatttatattcgaaataaaaaaagtctaccgtttagggtagacttttttctattgatgcctttttcttcgtagataggatgatgttttgacagtaaaatttatttatcctttttttggtgtgtgactgtttggaaaaagtgatcatacatcatcaaccaaatcatgatgatgaggttttttggttgatatagtaaacaaaatatatccctcattttcttttttggaaaaataaaatagtatctaaaattcaataatagtattttgaattattataatttttaaaaaataatgttgacaccctcggcgatatcattctatgattgtttacgtaaacgcttaccgtaaacgtttactataacgagtggggaggaatttgtttatgaaaaataaagaaaaatggagcggtgtattcccggctgtcttaattccttttaaagatgactattcaattgatgaacctgcttttcgtaagcttgtccgttgggtggcggatcacaaagggattaacgggatcgttgtcaatggacatactggcgagattatgactttactgccacatgaacgagctgaagcagtgcgcattgcagccgacgaattaaaaggggaagtacctgtcatttctggggtttctgcagaagggacaattgaagcgatccagcatgcaaaagccgttgaagaagctggtggtgaaggtatacttctcatgccgccacattcatggctaagattcggtatgcagcctgaatcacctgtccaattctttaaagatgttgcagaagcgattgatatttcaatcattgtccatcaatatccaacatgtacaaaaacctcatatacaaccagtcaattactagaaatgtcggaaattgagaatgttgtttcgtttaaaattggtcaaagagacatggcacaatacgaggtcgatgtacgggcattgaaaaaacatgcaccagatgtatcgttactcacatgtcatgatgaatatttattgccaacattggttcaaggcattgatggagcacttgtaggtttcggctgtttcgtgccagatttgatcgctgaacttgtgaaatgtgtggaagaaaaagaccttgtagcggctaataaagtttacgatagaatctttgaattaaagcatgctgtgtataaaatggatgaaccttcatctacttctcatctgcgcatgaaagaagcgatgtatcagcgaggtttgatcagcagctcgcttgctaggaagccggtattacctttaactgatgaggaaaaagaagaaattcgccagggccttcaaagtgttggtttgcttaaggaaaacgtcggtagataacagaccattgatttcatgatgaaggtgagtcaggttataatagtgtataaaacaacagactcccggaggtatgaaatgtgtcagtaagtattaaagatgtcgcattgaaagctggagtgtctatcgcctctgtttcccgagtattaagtggtaaaccaggagtaggtgctcaaacggctgaaagaatcaaacaagtgattgatgagttaggctatcgtcctaatctaggagccagagggctcgttaaaagaaagactgggaatatagcggtcgtggttccgcgtggctcatatattttgaataatccatttttttcgacgattttagatggtatagcgaaagagttagatgaaactgaattcaatatgttgatgtcatttacatctatacagcagcagcgattacttgaaacgcaagctgtagatggtgcgattttattttcgccaagaaatgaagaattgagcatggattggttaaaaagtttagcgattcccattattgttgttggaagttacttagaggattctcctttcccatgtgtcagaccagatgatgaagaaggtgtgtgtcaatctgtaacggccttatttgagaaaggtcatcgaaccattgggctggtcaatggtccaatgagttcgatgcatagtgtcaggtattacaatggatatgagcgaacacttaaaaatttagggttaacaatgaacaaagaacttgtgtttgagttagatgaatttgatgggggaaaagtagtagaagtggtttctcaatttctccaaggaaaccagcacatgactggagttgtttgctcttcagattttttggcgatgggggtcatgaaagctgcagatcacgcaaatgtgtctatacctcatgacttgtctgtcgttggtgccgatgatgtgcccattgcaagctttctaaccccttctttatcttcagttcatgttgatttagttggcatggggagaaaagctgtttctttattaacacaggtattagatggagatctgatagaggaaatggagcatatcttccctatgtactatatagatcggggcaccacgggaacgccaaaaaagaaatgatagatgctgaaaactcgtatgaacgctttagaatgtctcttgatttgaaatgtaagcgatttctttagcgctcttcggcatgtacttttgcatcatttcctctaataaggaggagatatcatgacgttagaagtcagcggaaattcaaattctcatgatgggcaagttgttgatagagcttcacaactattgacgagaatggaaagtgtacctttttctagatggcatttaaagcctcgtatcattatgggatctgccaccttttttgatgcttttgatgctctgtctttagcgtttgttctcccagttctcatcggcatgtggagtttatcacctgctcaaattggtcttcttattggatctggttatataggacaagcgattggtgccattttctttgggtggttagcagaaaggcgtggccgtgtttttagtgcaaagtggactgtactcctcatgtccgtcatgagtattgcatgtgtgttttcaggtaattttatggcactgtttatttttcgttttatacaagggattggggtaggaggagaggtgccggtagcagcctcatatatcaatgagctatcccgggctcaagggagaggtagattttttatgctttatgagatgatttttcctttaggtttaatgatctcagctcaaatcggcgcatttgtggtacctagttttgggtggaagtggatgtttttaattggaggtattggaggtttaatcgtctttgtgttcttttttatgttacgtgaatctccacgatggctgatttcgaaaggcagattagatgaggccgaaagaattattgtagaaattgaagctagtactgacaaacgaatgcctgtaaaacaagtatctaatagtactgaaaagggcgactggaaagagcttttttcaactttctaccgtaaaagaacattgatcgtatggggactatggttttctgcctactttgtatcgaatggtttaaataactggttaccaagtctttataatacggtttacaatttgccagttggagattcattaagggcagcctctctgacaaatattttacagactgtcggtgtattcgcttgtgcatttttgattgataaagtaggacgaaagcgctgggcaaccattgcatttattgtaacaggtgctttattaactgctttatggatcagcggagcgagttctccagaaagtgtgatctatttagggtccgctgcttacggaatgatggggacaatcacagttcttctctatttatatacacctgaaatttatccaactcgtatgagggtgattggaacggcatttgctactgcttggcttaggctggcctcagcgattgctcctattatgataggctttattttagaggtgagcggtgtttcaactatttttattcttttcgcaagtgtgactatagtgggagcaattcttgcttttaaaatgatcgaaacgcgcgagaaagtattagaggatattgcaccgtgattgacgcacgcagtgaagaacttattccaaagagggtaggttcttttttattcagaggatctacgtacaatttttaaaatgcctaaccgatctccgttcatttatcatataatagaaacatgaaaagccatacctgtgagacagtgaagatgtatatccgaaataaaaaaagtctaccgatgaaggtagactttttctataagttcaattcttggttccttgaatgagtgcagcttttaagcagaaggaaataggctgctgctgtgcatcgaattgaagctgaaatagctgctttgtatcagggtctgcggcttgaagatgggaaacgatctcctgctggacattttctggtgtgcgtccacgtatgatccagtcctgataatcaatttgcagatcccagaaacgaatctctttttgagttagttggttggcagcgaaaagctcttcccattctgataaagagctttctcgcacatgagaaggatctctgagtctatttaagtgattaatgaatgaatcctgtgccgcattctcaggtgcataatggtcgacgagcagaaatgcgccgcctttttttaagacccggctgatttcagacatggctgcgggaaggtttggaaagtggtgagcggcaaaccggcacgtcacgatatcaaatgattcatcagcgaatggcaatgcttctgcggctgcccgttcaaaagtaatatgttccagctggcgttcttttgcaagtgctgctgcaacctcgatcattttttgcgtgacatcaatgccgatccctttagaaataatgtctgaaaaggaaaaaacggtatgccctgctccgcagccgatatcaagtaaatgctcatgacccttcgtatttgctgcctcttttatccattccaactcttctccggctgcaaatataggtgaatctcgatagttctcggcattttgtgagaattggttttcggctttagcatatggattcaattttttctcccccttttgttgtctctttatcgtaaaattccttttgttatttgtctaagacataaaagatatggcatgaatagttaaaacctatgaggtgatgaaagtggatatacgaatgatggaatatgtcatggaagtgtaccggcagaaaagttttacaaaagcagcggaccagcttcacattgcacagccttctttaagccaacaaataaagaagctggaagaggaattagacacacccctatttattcgaaagtatggacaagtcacacccacacctcaagggagccggtttattaaaagggctgagaacattttgaaggaaagagatgatttgctgcgtgaaatgggagaagcagcttatgaggtggggaaagagttgaacattggggcgccagccgtcacagggggatatgtcttgcccggtttattaaaaaccttttgccaaacgtatcctcatgttcacgttcaactaatagaagaatcacctcgtgagctagaaaaacttctattggctggtcagctggatttggctattttatctatgccggtcgagcatgaatcattgaaaacgaaacacatgctgacagagccgcttcttcttgcagtaccgccatctgctcaaccttggttacaggcggaattgaacgatatcatcaatcaagcagatcagaaagggactgttccgtttcgccttctggaagacgctgcattcattatgctgaaagagggatatggctttcgacaagtggtcacagaactttgtcatcatcatggttttcagccgaagataacctttgaaacaagtcatattcaaacagcacaggcattggtcaaaaatggactaggtgtgacagttgtgccgaaaatggtggtacaagaggaaagaaacgaagtcacttatttgaaaattgattcatgtccaacccgcacacttgtgtttgcatatgtggaagaaaggtatttaacgaaagccgctcaagccctaatggacctttatcaaaaagcttaaacaaacgtttaattaaatgcaaaaagcaggggagcaccctgctttttaataaatatccagacgctgatctgtcatcacaggaatctgctgtctcacttcatccactagctgaagatcaatgtccgcataataaatatcttcctcatggtttgtttcaagtaaaatacggccaagtggatcaatcaccatggagtgtccagggaattcattgtctctgcttgtgcctgttctgttaacagcaatcataaatgactgattttcaatcgctcttgcgataagcaagctgcgccaatgatctactcttgctgacggccattgcgccgtattgataagcaccttcgcccctttgttgacaagtgttctggaaagctgcggaaagcgaaggtcgtagcagatcatcgccccgatctttacatcctcatcatagtcaaataaaccaagctgatcaccagcggttaaatagttgtgctcatccattaagcggaataaatgaattttgtcataatcgactaaaagctcaccttggcggttaaatccatacatcgtgttggtgatcctctcatcttctgtgcgcttgttcaatacacttcctgcaatgagaacgacttggtgcttacgggcaaaggaagagaaaagctgttttgttcgttcaccgtttacatcagccagctgatcggctttttcaagagcgtaaccagtattccacatttcgggtaaaatgatcagatcaggctgctcgcggatcgcttcttctaaaaatgcttctgctttttgaaagttcacatcaggttctccaatttgtacgtccatctggacaagggcgattttcatacaggttcctcctttattcgatgattgcgaatgtgaaatccatgaatggatttgttgatttgttttgtctaagaatctctagttttcaagccagtttctttatcataaaggtttcaatcttctttgccaatagaaatgtcagaaggttttgtcttttgtggtgaaaatgtctttcttcgtcaagaaaacagtgatatgatagccataactaataaaacaaagggggatagtaggatatgcagttgtttgatttaccgttagatgagctaaaaaagtataaaccgaagaaaacagcacgtcctgatttctcagacttttggaaggcatcgcttgaagaactgaaccaagtggaggcagagccagcaattgaaccttatgattatccagtaaagggcgttaaggtgtaccgcctgacgtttcaaagctttggtcaatctcaaattgaaggctggtatgcggtaccagatcaaacaggtccgcatccagcactcgttcgttttcatggctataatgcaagctatgacggcgacattcatgacatcgtcaattgggcactgcatggctatgcgacatttggcatgctcgtccgcggtcaaggcggcagtgaagataagacagtgacaccagcagggcagtctctgggctggatgacaaaaggtattttatcgaaagaggcctactattatcggggtgtttatttagatgcggttcgagcgctcgacgtgattcagtccttcccagaagtggatgaacaccgaatcggtgtggtgggcggcagccagggtggtgcactagcagttgcagctgcagcactttcagacattccgaaggtcgtcgtggcagattatccgtacttatcaaatttcgaacgtgcggtagatgtggcattggagcagccttatttagaaatcaattcatactttcgcagaaacagtgatccagaagcggaagaaaaggtatttgagacgttaagctattttgatttgatcaatttagccggatgggtgaaacagcccacgttgatggcaatcggtttgatcgaccaaatcaccccgccatctactgtgtttgcggtatacaaccatttagaaacagataaagatttaaaggtgtaccgctattttggacacgagtacatcccggcttttcaaacagagaagcttgccttcttacaaaatcatttaacgaattaaaagaaaagaggccactctctaggagggcctcttttttaatagttcgtattctgtctcgttttttcatcaggcactaacgcggtgataatgagggcaagggcagtgatgatatgaagaatgaatccgagaatcggaatccatgcaaggcaggatgtgacaattccaatgatacttccaatcattggtccctggtctcgcttcgataagacgagtgtgataatatgcagaataagcatgaccatgagcggcgaatagccattgctaataacgaatagacctccgatcacagggatagcaaggcaagcttcaaaaatcccagtgatccatttcataatgcgagatatagacatcagatccaactcctttttcatatatgtcttattcgtattttcccaaaacgtgaagaagtcatgcagaattctatagaaagagttgatggacacttgagagagagaattaaggaagagctgaaaatcatcgaaacaacgtatgacgtaaagatttgtcttgccgtcgaatcaggcagcagggcatggggatttccctcgaccgatagtgattatgatgttcgctttttatatgttccccggaaagaatggtattgggcgatggaagagcatcgtgatgtcattgaacggccgattgatgacatgcttgatatcagcggctgggagcttagaaaggcactgcgcctattcaataaatcaaatccgtctattatggaatggctgtcttctgatatcatctatgctgaatctttctctttggcaaagcagctaagagaattaaaggatcgagcgttttatcctgcggctttgatgtatcattacctcaatatggcgaagcggaatgagagccggcatttacgaggagagcaggtgcgaatcaagaagtatttctatgtgcttcgtcctctgcttgcctgtcagtggattgaacgttaccgaacagttccaccaatggactttcatgaattactcaaggagctagtggaggaaggcccgctgttagcagaaattcacgaactgctcaaacgtaaaatggacggagaagaaatggatgtagagaaccgtctcgctcatgtccatccatttattgatcaagagctggcgcgttttgatgaattggtgaaaagctacaatcagccgaaagacaatctgatgcaagaattaaatgagcttttgcagtctacccttgatgaggtgtgggcgtaggaggggagagtcagccggatagcggcagactctttttttatctcttattgtgataaaaccacaaaaaaagtcagaatttttgtcatcttcaaatattgtagcggacagcttatgagccttacaataaagacatagcttacaaagagtgggaggtgccctttatggagtcggtcacaagaaatttcttcttgtttttgtcaaagagcagtctcttgaaccatattgctcgtaattggggaagtgctgttgcatctaagaaaatcatcggtgggaaagattttgagagcgctatctctgtcattaaacgattaaatgatcaaggaatggctgtaacagtcgatcaccttggtgagtttgtcacaaaggcagagattgcaaatgagcggacggatgagtgtattcaaaccattcagcggattgcagaggccaagctcaattcccacgtgtcactcaaaatgacatcacttggactagatattgacgatgaccttgtgtatcgcaatatgaaacgtattttagatacggcagaaaaacaccgtatcatggtgacaatcgatatggaggatgaacagcgctgtcaaaaaacgctggacatttttaaagagatgaaatctcaatatgagtatgtcagtacggttttgcaggcgtatttgtacagaacagaaaaggatcttgatgacctgaatgagctgaatccatttttacgacttgtaaagggtgcctataaggaatccgccgaagtggcgtatccaaacaaaaaagacgttgatcagaattacaagaagctgatcgaaaagcaattactcacagggaactatacagccattgcgacacatgacgatcaaatgatcgagttcacgaaaaatattgtgaaaaaacacaatataccgacaagtcagttcgaatttcaaatgctgtatggcatgagatcagaaacgcagcaggcacttgtgaaggaaggctatcaaatgagagtctataccccgtatggacgagagtggtatggctactacatgagacgtcttgcagaacggccggcaaacattgcctttgctttaaaagggatgacgaaaaaataatttgaaacgggagcgtgacaaagatgacaacaccttacaaacatgaaccattcacggattttagccaggaagaaaaccgcaaagcgtttgaacaagcattagcaaaggtaacagaatcactaggtcaaacctatccgctcgtgattaatggagaaagaatcgaaacgaaagaccaaattgtctcgatcaatccagcgaaaaaggatgaagtcgttggaaccgtatcaaaggccggaaaagaagaggcagaacaagcggttcaggctgcggcgaaagcatttgaaacttggcgctatacgtctccagaagaaagagccagcgtcatcttccgtgctgcggcaagcattcgccgtaaaaagcatgagtattcagcccttcttgtcaaagaagcagggaagccttggaatgaagcggacgcagatacagcagaagcgatcgacttccttgaatattatgctcgtcaaatgctggagctggcgaaaggcaagccagtgaacagccgcgaaggggaacacaatcaatacgtatacacaccaactggcgtgacgctcgtcattccgccgtggaacttcttgtttgccattatggcaggaactacagtagcaccaatcgtgacagggaacacagttgtcttaaaacctgcaagtgcaacccctgtgattgcggcacgttttgtggaagagcttgagcaagcaggtcttccaaagggtgtggtgaactttgtaccaggaagcggagctgaagttggagattatttagtcgatcacccgaaaacaagcctgattacattcactggctcaagagaagtagggacacgtatctttgaacgcgcggcaaaagtacagccaggtcagcagcatttaaagcgtgtcattgctgaaatgggcggtaaggatacagtggttgtagatgaggatgcagacgtcgaattagcggcaaatgccattttcacatcagccttcggtttttcaggtcagaaatgttcagctggatctcgggctgtcgtccacgagaagctgtatgaccaagtgatcgagcgagtgaaggaaatcacagaaacgaaaacaacagcgaaccctctttctgcggatgtctacatgggacctgtcattgatcaagcgtcctttgacaagatcacggattatatcgaggtgggcaaacaggaaggccgcttagtgactggcggaacgagtgatgattcggaagggtacttcattcacccaaccatttttgcagatcttgagccaacatctcgcttgatgcaagaagaaatctttggacctgtcttggccttctcgaaagtgtctagctttgatgaggcacttgaagtagccaacaacacggaatatggtttgacaggtgctgtcattaccaataatcgtgatcatatcaaccgtgcgaagcaggagttccatgtagggaacctctactttaaccgtaactgcacaggagccatcgttggataccacccattcggcggattcaaaatgtcaggaaccgattcaaaagcaggcggtccagattacctagctctacacatgcaggcaaaaacgattagtgaaatgttttaagttggaaaagcatgaacctgtgcacacgggttcatgctttttttgcttgtctacgacttgtttctatgcaaatctgtccggaaagaagtatgataaatgtattacttaatcagggagcaatcgggatggaagagatattagaaaagcttcatacattttttgatgtcgataagttaattgcatttattagcgggtatttaaaaaaacctgtgattttagaaagcacagagtgtcagctccttgcttataattcttacagcattcagcagtttgacccagtcaatcagcaaacgattttctcaaaggaatgtccggggtctgtagtcgattggttaaagaaaacaggggttatcgagcggcttcacaaggagtcaaagcctttttatgtgagcggtcatgacgagctcgggtttaatcggcgggtggctgtgagtgccaagcacaaacaagaggttgtgggctttatttgggtgcaggacattgaggattctctcacgcaggaggagctgcaatttttgcatgaagcttcctttcaagtgggaaaagtgatttataagaataaaaaacagctggagaaaaaggaaggcaagattgaagaatttttcaaaaaggtcatggatgatcatttttatacagaagaagaactgaagtgggaggctgagaatttaagcatcccgctgccagcggtatttactgtcatggtcgtacacgctgccgataacaaaagtgagacggcagaagatgtaaaggatgtcattcgtacgtatttgcagcttgaagataaggtgaatcacgtatactccgttcaagccgacattgtcgtgatattgggcagcttgtcagaccggcactcaccgaaagccactgcggctgacgtcatcgctcacctgcaatcgaaagcgcatgcccatccttctcctttgtatattgggatggggagagagtatcgagatgtcatgaaaatgagcacaagtcgatttgaagcgatagaggtcgtgaaggctgtgaaaattgtggggggacaagagctgattccatatgattacgagaatctgggggttttccgattcttagactcgatttacagccatcaaaaaaagaaaaatgatttcaatccagatttgttacgtttgaaggaaaaagaccgtgacagccaaacttcatttttaaaaacgcttgaagtctacttgttgaataactgcaagctaaagccagccgcagagcagttgtttattcatcaaaatacattaaactatcgaatgaaacaaatctttgagatgacctcaatcgatttaagtcacttcagccagcgatgtgagttatttattgaattaatgctgatgaaaaaagatcaatagtcatcgaatccgcaggtgcccgtgatcacctgcgggttttcatgtgaaaaatggcatacaacggcttcgctacgttgtatgatagataaggattttatgagagagtgaaagggggaccacctttgggagcagtcaccttggccattttgattttcatcctgaccctcgtccttgtcatttggcagccaggacgtttaaccattggatggtcagcgtgtggaggcgccattcttgcacttgcctttggtgtcgttcatctgggcgatgtgtgggaagtgacgcaaatagtatggaacgcaacatttgcgtttattggcatcattattatttcgttaattttagatgaaatcggtttttttgaatgggctgcactgcatatggcaaaagccgcaaaagggaacggtgtccgcatgtttatttatttaacattgcttggcgctgtcgttgctgctttttttgcgaatgatggagcggctctgattttgaccccgatcgtcttgtctgtagtgagagcgttaaagctggatgagcggatgatcctgccttttgtgatggcgagcggctttattgcagatacaacctccttgccatttgtcattagtaacttggtcaatatcgtatcagccgactattttcatattgggtttctagaatatacagcaaacatgttcgtgccaaaccttgtgtcgcttggagcgagcatgctagtgctttatgtgttttaccgaaagctcatcccaaaaacatacgatctgtcacaagcgaaggaaccggcttcagcgatccgggatatccgcatgttccgcttgtcttggtatgtgcttggttgtctgcttatcggttattttgcaggggaactcattggggttccggtctccatcattgtgggcggtattgcccttgttttcttgtggctggccagaagaagtccgcaagtggcaacaaaacgcgtcataaaagaagcgccatggtccattgtctttttctcaatcggcatgtatgtcgttgtatacggactgaagaatgtcggtctcacagaaatattggcggcatggatcgaacaaggagcatcgcatggcttgcttgcgggaacgatgtttatgggtgtgctcgccgcagtgctgtcctcagtcatgaacaatctgcctactgtgttaattgatgcgattgcgatcggtcatacagatacagcaggcgtcatgagagatggactaatttatgccaatgtcatcggctctaaccttggtccgaaaatgacccctatcggctcattggcgacattgctatggcttcatgttcttaagaaaaaaggcgtccatatctcttggggtgcatacatgaaagccggaatcatcctcaccatcccgaccttgattcttactttattggggttatatgcatggttatggttcatacattaaagctgaatataaaaaagagcaggtcgcttggatctgctcttttttgttacagatattttgcatagcgtttttctaaaaagtcctgaagcaatgagactacactgcaaatgccccagtaaatgagggcgaccaaaatatacatggtcatataatcgaattcgcgcccacctacgatttttgcttgctggaacagctcgggtacagtaatcattgcagccagtgaggaggctttgattaaatcgagcatgacattggctagtggcggcagagcgatgcggacggattgaggcaaaatgacaccgcgcatcgtttgccaatagctgagacctagtgacttggcagcttctacctgtccgcccggcacagaggagagagccgcccgattgatttctgcaatataggcagcgctattgaagctgaatccaataatggcagcagtgaccgctgtaaactcaatcccgatataagggaatccaaaataaagaataaacaaaatcaccagaatgggcacgccacgcatgaatgagatatacagccgtgcaggcagccgaagcatccacgtattcgccattctggcaagcgcaataaaaaagccaagaatggtaccaaaaaacatgctcacaaaggaaatgagcagcgtcagccagatgcctttcatgacaaatggaaatgacgcctttgccagtgcaggattaaatatatattctaaatgaatatctcccacgcttgcggctccttatttcgaaatgtcgacatcttcgacatcagcatctattttctttgaaacgtctgcatgattaaagaatatttcggaaatctttttcatggttccgtcttttttcatttcttttaagacacgatttaattctttttgaagctctgtgttgtctttcttcatcacaaaaccttgttcgtttggcatgtattttaagtcagggtgaatcgtaatatttaatttcgggaatgcagctagagctagtgtctgcaagtaataatcattgagaatgacatctgtacgaccgttagcgacatcctttaagtattgctcatttgtcgcattatcataaataacttccttcgcaccgtacttgcgagcgacatccatataaatcgttgtggcagcaccagctgctttctttccttttaaatcttttaacgttttaatgccagacaaatcatcttttcttacgatcgccgtgccataagaatatttataaggagttgaaaaggcgaacttatcttttctgtcatctgtgatgtcaatgtcatttgcagcggcatccacttgaccagaattaatggcactcagcatgccatcatagcccatttctttaaattctactttcacatcaaggcgtttaaatgcttctttgaccacttccacttcataaccagtcaattgatccttgccattagctgtatcatgatatgacgttggataaagggtacctgaagtagcaaccacgattttccctttcttttgaatctcatcccactttgaatctttagactgtgaagagcctgattgactgcaagcagacaagacaagtatgaaagcagacacaacaagcattacccagatcgattttctatgataaaaacgactcatttaagaatcctcctctattttttatacaaaacaaaacatagcacgctttttctgttaggacaacgttttcagaagaaaagcaaaaaagtaagaatattatgtgcaatttgcgcgatgaaataatgtataaaaaaggaaagtgcgtacaaaataaatgcgtataaaggagggaagaaaatgatgaaaaaaataagtggcttgatcatattatcgatgatgctgttgtctggtttttatatggaaacagctcatggagaaacaccccaaatggaaaagcgtccagtaacgcatcaagtaaaactaacgacagaacaacaaaaacaaattgaaacgcttgagcagcaaattctttctaagcgaaaagaagtgattgagaaatatgtccaatatggtgtgttaacaaaggaacaaggtactcatattacgaagcgaatggatgagcattacaatcatttgaaaaacaacggatttgtgccattgctgaaaaaaccacagcaccatcgaccataaggatgaaaccggcagcgaggtgccggttttttattgtttgagattcttttcagaaggtgagactttcaccatcttgagggacaaaaatggcttgttctgcttgatgctcctgaatgtaagcttgtaaagaagctcttgttagcaagcagtgattcactgcctcaaggtgacaagcgacaatttgtgctgttgggtgagaatggtgaacctctaaaatgtcttccttcgtcatcgtaatcggatcgccttctaaaaattgagcagctccgctattgaccacaatgacatcaggcttgcgagtattgacaacctccttcggctcatcacacaaaatggtatcacctgcaatgtaaaggataggttcatcagggtgagagaaaacaaaaccgctgacttgtcccatccgcttcgctgttactcctgtcccatgctgtccacctgtccgctgaatatgaacaccacaaatgtctatttcatcttcaatgcaaatgacatgctcgaaaccggcttcttcaacgtcttttttgtcattctccgattgcgtataaatgggctggttttgggctaatttttgtttcgcctcgtcatcaaagtgatccacgtgcaaatgagtgagtaagacagcatctgggtgtagcatgttgtctaagtcaatgtttataggcagatcaacaatcggattgttcaaatgttgattggctgtatgaggaaacggtggatatgttccttttgctgctaaaaagggatcaatgaagaaagttgcctgcccatattcaaggtataaagtagcattccgaatgagcgtgattttcataaaaaggcctcctttttttctgattaagtttacagtatattaaaagagttccatgtgacagagggtaatgaaagtctttcatcagagggacttgatttttgaaagaggtgagccaatgttagaccaaaccgatatggatattttaaaagagctctcaaaaaacagtcgattaaccatgaaagcgctaggtgaaaaagttcatttaacgggccaagctgttgcaaatcgagtgttaaagcttgaagaagagggtgtgattgaagcatataccatttcgattgactggcggacgcaaaagaccatccaaacatttatgcagctctatacccgaagtcatcatcacgaaccacttctgtcatttctcgaccaacaggaagagatcaagaatttatttaaaataagtggtgagggctgttatatggctgaaggccatttctccagtcatgatgaactggatctgtttttaacggagctgacaaattacgcaaattataaactgtctattgcggttaagcgtctcattcatcagtaaaagaagagacgcaggaggataaggaaacgatgaaaaaattaatcgaaaatcaagctgaaccggtgacaaaggaaaaaatcaaagcagacttggttcaacttggtgtggaaaaaggcatgattttatgtgttcactcatctttatcatctatcggctgggtaaacggtggcgctgttgccctcatacaagcattgatggaaaccttaacagaagaggggacactgatcatgccggcacaaacgttagagctttctgatcccgctgattggatcgatccgcctgttcctttttcatggtggaaatcgatcaaagacacgatgcctgcatttgatccagcttactcgatgccaacagcaatgggaaaggtagtagaaacgttttggaaatacccaggcgtggcgagaagcaatcaccctcatttttcattcacggcttgggggaagaagaaacatgagcttctgaaacaccacgcactttcttttggattaggagaacattcgcctctagcccgcatgtatgagcttcaggctcaggtgctgctgattggtacgtcttttgaaagtctgacagctttccatctggctgaatatcgcatccctcagcaagacctcatgacaagaggagctcccatcttagaaaatggatggagagtatggaaagaataccaggatattatcacaagagaagaactatttgagcagatcggccgtgactttctgcaatcaggaggcactcatcatcacggacaaatcgggcttgccagttcatatttattaccgatgaaagaatcggtagattttgcggaaaagtggcttgatttgtacgatcagtcgtgatctacacagtttggaaattgatatgataaaggtcttgatcaggctgctgtgaagtatagcaggtgagctgatagtctccctttggaatagggaaagacagtacctgagccatgacgcttgtgagataaacttgatcgcttgcatgagtaaaaggtactgtgactgttctgtcagccgaggctgggggcatatcgctatttaaagtaacagtaacagatgcttttccgttgttgaccccttcaaaggatacaccgtgatctcccatggcgaatccttgaagaatgtcatcatctgaccagtcaatcacaggtggtgttttgcttccgctgtatacggtgatttgatgataggagatagatagggaataggcttggtttaagttattcatttaaaaaacccctttatacatagatttcggttggaatgtgaatggttgaaagagtgaatcttgaagagaatgttaggcagcaagacgattgtcgccgtcttgcgcttctatatgaggaatctagatgtgaaattgtgaaaccattgcttttaaatctcctgctaaatgagcaagggcttctgatgaagcagttacttcttccattgcggcaaattgttcttctgttaagccggctacttgctgtgaatgttcactcgttagtttaaccacttctgtaatagtggcaaaggattgtttcgcatcgtttgtataagctgcgattttttgtgatgcactagataaatgcttgatgccatctgccatttctctcattgactgttgaatatcaataaatgattcttctgtatgagaaataagtacagacccttgagccgcttcctctcttactcgtttgatcgcatttgttgaatgagtcatctctttttggatttcagaaatgagatgggaaatcatatttgatgaggcttgagattcttcagcgagctttctcacttcgtctgcgacaactgcaaatcctttcccatgctcgcctgctcgtgctgcttcaattgctgcgttaagagcaagcaggttggtttggttagcgatgtctgtaataatatgggaaatatgatcaatttcagccgaacgtgtttctaatgcttgaatggctgtcccattttcctctattgattgtgcaatagatgtcatttgtgagtttacttccccaatattctccacaccttttagggccatttcttgtgcaaattgacttcttgaagccatttgccctgcattttccgtgatgtttgccaactcgttagatacttgaatcatcgtgtgcacacttgttgtcatttgagttgactgttcttctgatgaatgagcgacttcttgaatactatgggtgattttttcggatgctgcacttgtttcctctgcactagctgacagctgttcagatgaggttgccactaattcagatgtgttcatcacattaagaatggtgtgatttaatttttcccgcatcttattgaaatgatcagccaaatcagacagttcgtcgcctgctgtatctgtcacattgatggtcaaatttccttcacctgcactcttaatggcagaagccataagcttgagacgggtttgaatccgctttgtgaaaatagaaataatgattacagcaacgattaagcttaacaacagaacaatgaaaaattgaatgtagaatgactgaagcatttgtgaaatcatgctttggttggcacccgtataaaaaataccgatcgtttcacctgcatcatttttgattggcatataagccgtttggtagtctttcccagcaacatttgctgtgccgtaatagttttcacctttatctaatacagtggccttcacttctggtgaaacttgtgtaccgacagctcgttttccgtttaacatgacattcgttgcaacacgggtatttccttggaatattgtgatggtatcatcggtgtattctgctaaatggtcgaccaatgtatcatgatcattgatttgggtattccctttgtaaagctttccaccttttatctgccacgagcctgctactttttcatctaggtaggcatagcctagctttaaatcaccttttgctttttcagtggccatgtgcttgatgttttctgtcatttcacgattcaccacataaccaacaattgctgagaagataatgatgacacttaaaaagatcagcaaaattttggcaccaagcctcagttttccctttttcttcatgctttttgactcctttaggtataaggtaggataaacctccttaaggattatcggcatgaaaaaaatgtttgaaatacctgtaagcagttacgaggaaattttttttagatagaaaagggtcatgtcgttaatcgatgataaattgtattcttgtgccgtcaggatcatctgataattgatgaccgacccaagagcctgctcctctattatctgaaggactaatgtatttgactgaagctcctgttcctccttccttacacatcgccatcggccattcgtcccgatcatatccgcgctttgttgggatgccatgaagtgattgttctctttgttcatcgctatgtttacggtcaattgtacatacggatgaatggccttcatcaattgcctcttctatgtgcttcgcggtttcggggtaacgatctgatgggaagtgaatcgttttgtcataagatgaattcgtcgtctcttgtttaccttgctccagctgaatatagcctgttgctacaccaacgatgatcagtaaaagcaagagaatgattttaagaagtttcatagatgctagctctctttcttgtttgcgtattttgtaaacagaagtatagcagaattacttaccaatttctcctggttttgaaaaaacgccttttaaagttcgaaaaacggtttttatccgttttcttgcttttcacatctaaaaaaattcataaaaattttaatttttcagttcataaaaagaatatgctttatcaaaatggctttatcactgctttttgggctaatttcaagaatttaacacacagaaattttaaaaaaataaaattgactagaccgatatgctttaataatatggagtcaaatatcaaaaaatgtcgtaatttatcaaaatatcattctatttacattgtaggagggaagtacaaatggcggatgtctcttatcggcttggtatagacataggcggaacatttactgacttatcgctgatgaatgaagcaacaggggcgttaactgaactcaaaacacccacagtgactgacgacccagctcagggaattatcaatgggctaaaacttctaaaagacagaggtgttgatttatctaaaatccaatatctcgtacatggcatgacaatcggtcttaatacattgttgcagagaaaaggagcagatttggccctttttgtgacggaaggctttcaagacatattgtcactacagcgtttacgactacccattccttatgacttcaattctcgtttgccagaaccattaataccacgaaagcacgtatatccaatctctgaaaggttgatacacgatggtacgatcaaaaaacctctccatctgcagcaattagatcatgctgtccagcaggtcatgtctaaagggctagcaggtattgttatttcttttttacatagctatcaaaatccagttcacgaattacaggcaaaagcctatatcaaacaccattatccgcaattagaagtccttacttcatctgaattatggccccaaatgagagaatacgagcgtaccgtgatgtctgttgtcaatttgtacatccaaccaaaggtgaaacagtatttacaaacattgaaaagccgtttgaaagaagaaggtgtaccaatttctccatacattacccaatcaaatggtggtttaatggatgcagaaagtgcagcaacttcacctgttaaaacacttttttctggtccggcagctggtgtcattggtgcggcaagaattgcagcttctgcaaacgaatccaatctcatcacgtttgatgttggggggacgagtgcagatatttccattattcaaaatggacagcctacaatggctcagtcaaatcagctttcaggttttcctatcattcttccatctgttgcgatgtattcaataggggcaggcgggggttctgttgcatggattgatcagggcgggcttctcaaagcaggaccagaatcagtcggctcacaaccgggacctgcttcgtatggtaagggaataaaagccgctttaactgacgcgttcctcatatgtggttatctcagtcaagaacgttttgccggaggacatctacaactacagctgtccgcggcagaaaaggcctttcagccaattgctgaccagctcaacaaaaaagtagaagaagcggctgaccagctgattcaagtagctgtcgccaatatgtacacagaattaagcaatgtcatggagcagcaagggtttgacccaagagattttagtttactagcgtttggcggagcaggaccagttgtagcgaatttccttgcgcgagaaattcatgcgaaaaacgtggtcgttcctccaagtccaggaacattatgtgcattaggtgccctgaacgctgattttattcatgatgcggtgctgtcgaagaagatatgcttacaagactactcgatagatcaactaaaacaggattatgagatgctttctcgaaaagcgactgattggttcagtcagcagaacattcagcatattaaacagacatccattctattattggcagatgcacgttatcaaggacaagcctttgagattgaattaccattatcagctgaatggctgaagcaagaacaagatatccatcaactcgttgaagcctttcacaaactacatcaacgtcaatatggtcatagagatgatcaggcgaacatcgagttcactcatttacgagttcgagttataggcgagacgccgccgctgcctttcacacctgttcatgaaagcagcggacaatctttgaagccacatgaattcaggcgaatctttatagaagaaaaagaatatgaagcagctatttattacagaaatactttgtcagtaggttctgtcattaatggacctgccatcattgagcaggatgatacgacaacattgattctgccaaattgggcaggcagcattgatcaatcagggaacttggtgatttcaagggaggcggctttacatgagaactgatccagcaaagcttgagatgatgcgcagttattttaatgcaattgcatctggcatgggacatgtcattgagcggacgtcttttacgactttcgttaaagaatcagctgactttgcgacagcgttagccacgccttctggagatttctttgtttatccgaagacagtgggtgtcacgatctttttagggctgagtcttaaaaaagcgattgatgagagcggaccaatgcagccaggagatattatcatcacaaatgacccttatacgacagatggtttagcgactcatctgccggatgtccatatcattaagccgattttcgtagatggtgaaattgtcagttatgcttggtcttttgttcatgtaagtgatgtgggcggacttgtgccctcgagtatttcaccgacagcgacagatattcatcaagaaggattaagaataccgccagtgaaaatttatgaaggtggaaaagagaatcaggttgttcgtacttttttaagagccaacagccgagctggtcatttaaatgatggggatatcaatgcaatgattgctgcagtaaatacagcagaaattcggttaaaggaaatgatcgggaaatttggaataaatgaagtgaaacaaggaatgatggacctcctgaaacaagctgaggttcgtgcaggaaaggtcattgaagccattccggacggaacgagtgaattcgctgattatttagatgatgatatgatctcggatgtgccgatccggttgaaaatcaagttaacggtgaaaggaaagcggctgacgcttgatttttctgagtgtgacccgcaagtgaaaacagcttttaaccttgtcaccaatggtcagaagcattcctttctatatcaaggattgattaattacattattagtaaagatccctttataccgattaatggcggaatcacatttccgattgaagtgatttcacctaaagggacgctagtgcatccagaatacccggcttctgttggtattcggcattcgattacgatgaggctgttcaatgtcgtgctaggcgccattggtaagctgttacccgaagctgtgccggcagcaggtgcaggtcaatctgccattgttgttctctctgttcctgataatcaaacaggtggcaggaaaatgtctgttgttgaaccattaggcggaggcggcggtgctcaaaatggaacggatggagtagatggtattgatcattcgtctggctttttgaaaaatacacccattgagagcttagaacagcatattgatattcatgttcaccgatatgagcttttgccaaatacaggcggagcaggagaaaacagaggtggacatgcgattggtttggaatttgaaatgatcaagcctgaatccatggtgaccgcacgaggtatggaacggatgaagtttcagccttggggattaatgggcggccgagcgggagctatcggtgaggtcaaactggtcacagcaaaaggtgaaaaacaagaccagccgaaaatagatgttctacgacttgaaaaaggcgatattgtgcaattgatatcaccaagtggaggcggatggggaaatccatttgcaagagagaaagaaaaagtccttcatgaagtagaagcaggtttattaagtgaagaaagagcgctacagcaatatggcgttaaagtgtatctagaccaaaatgaatggaagattgatgaagagcaaacgaatcagcttcgtgaaaagggtaatcaccctgctcatatcatgtgggatgtcggagaacacagagaagcttatgagaaagtatggacggatgaagccagcagcgagcttgctgtgcggctgcgctcctacccagctaacgaacgtacacattataaacatgaagttcatcaatatttcagtcatagaaatgagccgttaacaaagaaagatattattcaagcacttcgtcatatggatggacaaaaagggggaaatgaatcatgaaaagaagattaatcactatttttgcaggtgttctgtcattgattctactgctgacagcttgcggtgggaatggacaggatcaaggtaaacagcagcagactgtgatcgttggcgtatacggaggcgattgggaaaagaatatcaaaccgatcctcgaaaagtttgaaaaagatacgggaattaaagtccaaacagtctctggtgcggattctgaatggtttacaaaattaaaagcgtcaaatggtaaaaatccaccgtatgacctacttattttacagcctgatacgattcaaagaggcattgctgcaaacgttctttcacctatcgatgaagatcaagcaccgaatgtcaaaaaactttaccgctctgttcaaaagaagctcactgtcgatgggaaacaatatgcagcaggctttagcatggggcagctcggaattgcttatagaaaagacctcgtaaagcaggaaccaaacagctggactgacctatggagcagtcagctaaaagggaaggtagccatttcatcgccaacttattcagccgggttacaatttttctctgcgcttgtccatgctcaaggggggacagaatcaaatcctaaggatattgataaagcctttaaaagcctttcgcaattaaaagggcatgttgctgcttttccagataatccagggtctattcaaaccttgttagaacgtggtgacgtcgcagcagttccatattgggatggacgatcatttgcacttgaagaagaaggtatgaatattggtttctcatatccaaaagaaggcgctgttgcagcagttgcgagctgggctttaacgaagggaagtcagcatgaagaagcggcttacaaactattaaactatttaagtggaaaagaagctcaggaagctttctcggaaaaatcttattatggtatgtcgaattctgatgtgaaatacggtgacaagattagggggaaggtcaaggttggagagaattattatagcaagctgacttgggtagattacgaaacagcaacttcggagctgggcaattggacaaatcgatggaacgaagtattaggtggaggaaaataggtgatcgtatgagtggaatccatttagaacatatcagccagcatttcggcgagcagattgctcttaacgatgtcagtcttacggtgaatgagggggagtttttctcccttcttggtcctagcggctgcgggaaatcaacgttattaaacatcattggaggttttttagagccaacaaaaggtgtcgtctatattggtgatcaggatgtgacgaatttaccaccttatcaaagaaaaacgggtatggtttttcaaagctatgcactctttccgcatctgaccgtctttgataatgtggcgtatgggttaaaggttcaaaagaaaaagaaggcagaaatcaaagagaaggtaatggagagcttgtctcttgtgcaattagaagcgtttgcgaaacgtatgccgcatcaattaagtggtggacagcagcagcgggtagcgattgcaagagcgcttgcgattcagccatctgttcttcttcttgatgaaccgctcagtaacctagatgcaaaactaagaaaaaacatgcagacagagcttagaaatattcaaaggaatgtcggaattaccaccattctcgtgacccatgatcaagaggaagcattaagtctttctgatcgggttgggattttaggagagggtaaaatccagcagatcgggacgcctttagaggtgtaccgccagccaaacaatcgatttgttgctgaatttatcggacaagtgaacctatttgaggcagtctatgatgaagcaagtgctgcatttatcgttcctcatttaatccagtcaaacgggcaggaagttcagttaaaggcagcggcacaccaaaagaagaaggaaaatcagttgctcatgctccgtccagaaagaatcagcatatcttctgagcggggagacgttcagtccaaccatgtatcaggcgtgctgacagatgtcagttatattggtcactcattacgtttggtggtgggactcaatagaggtgaaatgattgttcatgctactgatgcggcatttccagagctgccgaaagctggagaagctattcatatcaattggcagcctgaagatatcgttttcctagattcgaaggtgcatacgtgatgcgtatcaagaaaaagaatcagcgatttcattggttcatgctgctgccagcgtgtttgtttcttgttgtatttcttctagtgccgcttgtgatgatgttcgtcctcagttttcgcgacgtggattcaatgatgaacacattacaaacgtatagcttttctcaatatattcatgtgtttacgacagatgcgtatgtgaaggcgattggaagtacagtgtgggtagccttgcagacaacagtgatttgtttagtgatggcatacccagcagcatacgtgctcgtcaaggcacctcatccacgtctgcgggcatttttctatatcttacttgtctcgccgcttttgacaagcgttgtaattcggacgtttgcgtggattgtccttctttcacaaaatggtctgatcaatggcatgttattagatttacatgtgattgagaagccgctctctatgctgtggaatatgaatgcggtgattattgcttatgttcaggtcatgctgccttttgcagtgctgcctatcgcgacgagcttaaccgatatggatcgtcatttacgaccggcttctatgagtctaggagctggacgaattcgaaccttctttcatgtgacttttccactaaccattccagggatggtgactggggctattattgtcttttcgctggcagctgggagctatatcactccgctcttagtcggcggaagaatgcagccgctgctgccgctgtctatttatcagcaagtcatgcaggtgtataacttgcctcttgctgcagcgatgtcctttacgttattggtttgtgtgcttgtcgttgtcagtttattaagctatctattgaagcgttgggaggcgaggatgcatgcgtaaaaaatcatttggtgatcgcttgctttcaagcctgatttggactgctgggtcattggtttatctctttttgaccatacctgttcttgtcatcgtcttatctgcttttagtccaaatgccttccctgaatttccgccgacttcgttctctgttcgttggtttcaagaggtcgtgtcgaatccagaatggatggagtctctgcgtatcagtgtgattttgctaatcatcgtaacgcctctcacggttcttttaggcacgatggcttcatatgctttagcaaggctttcctttaagggaaaggaggcgattcaagccttcattttgtcacctcttatgattcctcaagtagtgttagggattgccatgctctatttgtttacggctatggggtttacaggatctttgtgggcgcttgtcataggtcacgtcatcattggctttccctatgtggttcgaacagtaggcgtcagtgtctcgaatttggacccgcggcttgagctagcttcaatgaatcttggcgcaggacctattcgcacattctttcgagtgacgctgcctttgataaagccaggaattattgcaggcggggtattttcagccgtgacgtcatttggggaaatatcgatcagtttgttcgtttcctctccccaaacgattacaattcccgtcaggacatttaattacattgagcaaacctttgatccgagtgtcaatgcgatatctgtcatatttattatcatttctatcattgcgttgctcattattgaaaaaacaattggtctgtctaaggtgatgtaaatataatgaagaaacaagggagctgtcatttgaaatggcagctctttttgtgttgtttttacggtaaatattttcaattttttagggaatatagttcttaagatttaagaaattgtgagggatggaaggagacctctatcctacattttcggtcatattttcaaaatttaaggaaaaacatgaaaattttgcggtatttagtcaattattttcggttgaacgcaactattattagttattttcggtaaatatcgtaaattattatgtgattcattcggtataacgcatgaatctttacacccatttttcggtgaaaaaaacaataatttcatataaagtggacgtaaatagaaaatatttaaaaagaaaagaagaaaaaggcaaatctatggaaacgtagagacgcaaagccatgtcctaaggtaaaagttgttttttactatggtcggcaggctaccgaatcaaaatgggagtccctccgttttattcggggtgggcttctttccgtattctgtctattttaatgaaatagacttggttcttttgatatagagggtgcagggttgtcacaatggtggagaaaacacagaagaggcggaggatgaaaatgaatacagtttattaccccttaacacatgcgcaaaagcgagtattctacacggaaagattttatccaggtacaagtatttctaatttgggtggattcgccagattgagatcggtatcaggtttagatccatctttggtcgttgacgtgcttcaagcgtacattcgccaaactgactcccttcggctgaggctagtgtatcaacatgagcaggaggagcctgttcaatatatcaagccttatgaagaacagccgattcgcatggagaagggctggagtgaagaagaagtgagggcttgggcgaatgagcaaatccgtgagccgatgccgttgattgacagccccttgattgaatttacagtctttcaaatcagtgatgaagagtgctggctgttttgtaaagcacatcatattgtggcggatggtatctccattatcttgatgggaaatcgcatcatcgacttataccaggacatgctgcacggggtagacatctcaccggttgaggagatttccttcgttgaccatatcatgagtgagcaaagctatgaaacttctaaacggtttcaaaaagaccaagctttttggaatgagcaatttgccaatattccagatttcgcttctttaaaaccgcataagggatacgagatgagtttacatgcggagcgattttcaggggatattccagattctttgaaggagaaacttcgtgcgttttgtgaagagcagaaagtcagtatgctctcgatgtttatgtctactgtttatatgtatttgcatcgttttagcggtatggaggatgttgtccttggaacctttatgggcaaccgaacaaatgccaaagaaaaaaagatgattggtatgtttgtttccaccattccgatgcgtgcatctgttcaggggtcgcaatcatttctggatttcgtcaaacaggtcatggcggatcaaatgaagatcttgcgtcaccaaaagtacccttacaatcttctcatgaatgatttgagggaaagagaagggtttacaggacgcctttttgatatttctttagaataccaggtcatgcagtggcagaaaaaagagaatctgtcttttattactgaaccgatctttagcgggagcggaatgaatgatatttccattcatgtaaaggaccgttgggatacagatacattgaccattgatttggactaccgtacagatgtattcaccgaagaagaaatcagtcagatgtttgatcgattcttaatcatactagaagcggcagtctcccagcctgatcagctgatcgggaaactccctttacttccacaagatgaacaaaaggaactgctgcaattatctcagagaaaaccgtttcaaaaaccagctgaaaagccagttcatcatttgtttgatgaggcagccaataagtatgcagagcggaaagccgttgtagcagaaaatggagcattgacttatggagaactgtatcaaaaggcagaaaggctggcgcgttttttacaaatgaaaggtgtctcgcgtgatgtgcctgttgctgtcctaatggatcgaaaggcagaggctatggtggcgatcttcggcatattaaaggctggcggggcgtatgtaccgattgatccggcattacctgaggagcgcattcaatatattgtggaggattctggtgcttccattgtgttaacagaggaaacgttcgtttcaacataccgtgccctctcggaaaaaatggtcgtgcagcagcaaatcgaattagatgatgaactgctgcctcagcttgtagatcaatcggtaccagaggatttggcttatatgatttatacatcggggacgactggaaaaccgaagggcgtcatgattgagcatcttcagctgcatcatttggttcatgccttgcatcatgagatttatgaggaggcgagtgagcttcaaatggcgcttcttgcaccattccattttgatgcatcggtgaaacaaatttttgctgcgatattatttgggcatacacttcatattattccgcgagaaacaacgagaaatggtgttcaattagcggcttattatagaaaacatcaaattgaagcagcagacggaaccccggcccatgtacagcttttacttgcagcggaattagacggtctgtcattgagacatatgttagttgggggagaggcattgcctgcgaaagcagcatactcgcttattgaagcggttcgtatgagtgagcctgcttttactttgtggaatgtgtatggtccgactgagacgtgtgtcgatgcggcggttcatcgcctagaactaagtgaacttcgcgaatcatctgaacagcagcgttatgtgtcaatcggaaagccgctcggtcatcaccgtctttatattttaaatgaccatgatcaattacaggtacagggggctgctggagaactgtgcattgcagggataggtgttggacgaggctatgtgaatcagcctgaattgacggagaaagtatttacggcagatccattttctccaggtgagcggatgtatcgaacaggggatctagtcaaatggcttccagatggcacacttgattatcttggcagaatggataatcaagtgaaaataaggggttaccgcatagaaacaggcgaaattgaagcagtgatggagcaggtagatggagtgaatcaagctgtcgtactagtagttgatgaagcggacggggaaaaggtgttaagtgcgtactatcaagcccgtcatgaagatgtgtcagttgacatgctgcaagccgctatcaaacatcagctgccagcttacatgatgccgctctatttcaaagagcttgatgcatttccactcactgtcagtggcaaagttgatcgtcgtgcacttgctgccttaaaaggtgataaagccgttcaagctgtttatgctgcgcctagaaacgatctcgaaacgaagcttgtgcgtttgtgggaagaaattcttggtcaagagaagattggtatatatgattccttcttcgaacgtggggggcattcgctgaaagcaatgactgtactcacacatgtgcagcgagattttcatgtagaggtgcctctatccattttatttgaacagcagaccattgcggctttggctgcctacattgagcaagcggaaacatcttctgaaacggtgatacctaaagcacctgctttagaccattacccattgtcacctccacagcagcgcgtttatatggtgagtcaattggagcaaagtactgcatatcatatgccagctgttgtgaggttaaaaggaacgctgcagcaagagaggctgactgaagcctttgaaaaactcatcacacgtcatgatatgctgcgtacgtcttttcatacgttgaaaggcgttcctcgtcagcgggtagctccatccgtaccttttcaaatagagcagctaacaggcggtatgatggaagaaaatatgcagaaatttgtcagaccctttgaccttgagtctgcaccacttcttcgcattggcttgaagtcattagatgatcaggagcacttgctctttttcgatatgcatcacctgatttcagatggtctttcgattgatttgatgctgcgtgagctatcagatgcttacgaaggatccgttaaagtcccattgaagcttcaatatcaggactatgctgtttggcaagaacaacaaaattttcaaaaagaagaggcattctggctgcaggaattctcgggtgatcttcctgctttacagctgctgaccgattatcagcgcccatcgattcagtcgtttgcaggggatcgtgtgatcaaagaaatcaatgaaacgttaaagaggcaattacaggagctagcggcaaaacaccatacgacactgtatacggttctgcttactgcttactatacattgcttgcgaagtacacggggcaaaaggaattcgtggtaggaacaccggcggcggggcgagtgcatgcagacttggatgacatgattggcatgtttgtccagacacttgcattgcggtcagaggttgatccaaataaaaccatgtcgcagttgatcgagcaagtgaaggaaaagacgatgcatgcatttgagcatcagcaatatccatttgaacgattgcttgaaaaactgaatatgccaagagattttagccgtcatccattattcgataccgtttttacactcatgcgagatcatggatcagcccagcatattggagaaatgcaagttgaaatcgaagaaaccaatttccatattgcaaagtttgatttaacgctgcaagcaatggagtcagatcaaggtttatcctttgtcctcgattacagtacggcgctatttaaacgaagtacagccgagcagatgctgcatcattatatgtatttgctggagcagatggtccaagcgccggaggaagcgatccgatcttatcgattactttctgaacaagaagcagaagctcaactgaatctgtggaatccgttaccttcgccttatccggcagaagaaaccattgtgacgcagtttgaagcacaggtggaggcgcacggtcataagcctgcactccagtgtgaaggcgtgattctttcttaccaagaactaaatgaccgtgtgaatcagctggctcattatctgcgtgaacatgggtttgaaagagggatgaaagcagccttattctttgaacgatctcatgagatggtactctctgttctagctgtacttaaggctggcggcgtctatgtaccaattgatcctgattttcctgatgagcgcgtgaagcactttttaacagacagcggtgcgcaattcttattgacacatcaagtgctgcgccatcgctcggtgctcgcttcttttgagggaaccatcatcgaaacagaagatcaggcaattgatcagcaatcagacagccctatagatgttggtattttaccagaggacttggcgaatttgacctatacatccggtacaactggaaaacctaaaggaaatatggtgacacaccggaacattttgaggacagtgaagcaatcaaattatcttgccattcatcatgatgactcggtgatgagtctgtcaaactatgtatttgatgcttttatgttcgatgtgtttggtgctttattaaacggtgcgaaactgattgttctgccaaaggatcatatcttaaacatgaatgagctttctggagcgattgagaaggagaaagtcagtattttaatgattacgacagctctttttcacttacttatcgatatgaaaaaagacagcctgaagaacgtcagaaaagttttgtttggcggagaacgtgcttctgtgcctcatgtcatgactgcacttgaaacggtaggggaaggcaagcttgttcatatgtatggtccttctgaaagcacgattttcactacgtattatcctgtgaatcaaattgagaaacaggcgttgtctatcccaatcggaaagccagtgagtcaaacggctgtttatattgtagatgaatttggacagctgcagccgccaggtgtagcgggagagctatgtgtcgctggggatggactggtcaaaggatattatggacagccagaactcacaagtgaaaaattcgtgaaaaaccctttccgccctggtgaggtcatgtataaaacgggtgatcttgcacgctggctgtcaaatggagagattgaattcattggacgaatcgatcatcaagtaaagattcgaggtcagcgtattgaacttggagaaattgagcatcagctgctttgccatccgcaattgaaggaagcagtcgtcattgcagccccaaatgacacattatgtgcattttttacagccgaagggtccgtctcattaactgatttgcgcgagcaggcaggacgtgaactgcctgtgtatatgatgccgtcattcttcatgcaattagacgagctgccgctgacgaataacggcaaggtagataggcgtgcgctgccagtgcctgacttaagtgagcaaggggtaaatgagtacatcccacctcaaacagaaacagagcgtcttgtagcgcgcatttgggaggaagttcttgaagcgccgcgaatcggtaggcacgatcatttctttgaatgcggtggccattcgctgcgcggcatgaaaatgctgaacaagttgtatgaagagatgcatgtggagctcactttgaagtctttatttgaatctccaacattagagacgtttgcctttgaggttgatcaagcggatcaaacggagatcaagcgggtggaggttgcagaagaagcggcctattatccagtgacatctgctcagaaaaggctgtttgtattggagaaaatgaccgatgcggagcaaagctatcatatgccggctgctttaaagcttgaaggtgcttttgatgaaaaacgatttaaaaaagcgattgaacagcttgtccatcgtcatgaagcatttagaacgagctttgattttgttcagaatgaacctgttcaacggattgaatcaaacatctccgtagacattgagacaatcgaagggaacggacgagacatacaggaattgatgaatgactttatccgtccatttgatatagaaaaggcgcctctactcagagtaggtctagtttctggttccgtaaatgtccattatttactgattgatatgcaccatatcatttcagatggtgcatctgtgggcattttaattgaggagctttcagccttgtatcgaggagacaaactagaggaattacctgttcaatataaggattatgcggtttggtcaaaaagcgaggcgtttgctgcacaaatagaagctgaagaggcgttttggctgaaacaattagaaggagaactgcctgtactggcactgccagaagatctgccaagaccaaaagtgcaaacattcgaaggagaccgcgtctcatttacaatcaatgggccacttaaagcgaaattggatgagctggtcagagcgctcaacagtacgacgtatacagtgctgctcacttgctacagcatccttttaagcaagctgtcaagacaagaagatatcatcatcggttcaccgattgtaggtagaactcatccggatattcaatctgtcattggtatgtttgtgaacacgctggcacttagaacaaagccagcaggacatctgacagcggcagaatttgcgtcaaatgttcatcagcttgtgttagaggcaaatgagcatcagttgtatccatttgaagaattggtagaccatgtgcaaacggttcgagatactagccgtcatccaatctttgatgtggtgttctcgatggaaaatgcagatatccgtgatttaacgatggacggacttcatattgttccgcagccattcgaagagaatatcgccaaatttgatttgaccttaactggaaaagaattagctgatcacattgagcttgtgttcgattttaattcttctatttttcaaaagtcgtcgatcgaaaagtggaaggtgtttttccttcatttattggaacaaatggtatcagcgccagatcaattgctggatcaaatgcagctattatcaccgaagcagcagcaaaaactgctcagtgaatggtcaggtcctgtactaaacgttccgtcagatcaaacggttcatgcactgattgaggctaaggcatacgagacgcctcatcaaaaagcggcgaccttctgcggaacgagctggacgtatgaagagctgaacaatcgggcaaatacagtcgcttcaaaactcatctcaaacggcataaaaggaggtggccgcgtcggcattctgacccgtccgtctcttgacatgacggcagctgtccttggcgttctcaaggcaggtgcggcattcgttccagttgatgcggattatccggatcagcgtattgcctatatgctggaagactgcggggcagaggttcttctgatgcaaaaagggctggctgcaccatcttcattcacaggtcatgttctattgatagaagatgcggtagaaggcgaagcacaagacattcatgttcatgtcaaaccaactgatctcgcctatatgatttacacgtctggaacgacaggacagccgaaaggtgtcatggttgagcaccagtcccttgtgaatctggcgttctggcacaatgatgctttccaagtgaccaatgcggatcgaaccgctaaatatgccggttcgacatatgaaatggagaaaatgtttaaacgggtgatgtgatcaaataaaaaaaagacaaagggccaaattagccctttgtcacagtctgaagcgctcttataagagcgcttttttatttagcatccgcacggattgggcggtgtgaccacaactggtcgtgtttgaatatcgagggtgtcctctgcataaaatttagaaccaatgctaagcgcacggttttctgcacggaacgtatatgtacctgcagcaggaagtactttatgtgaaagttgtaatttatattgtgagattcctaataaatcgattctagctggaatgcggacagtttttccactgttcaaaatgtagctgtcttttagtgcttttccattgaagatgtcttttgttgtcgcttgaaagcctgcaggtaatgtgaactcaatggcaccgatacttaaaacagaatttgggcggtatgttagctcaatgtctgaaaaagaccattcctgcttacttgtacctgtaattttcgcataaagctcagctggtctggcatttgttgatgctttgccttcctctgttttggctccttcagcggatgcggcaatcggtaccgatagtgccatgaccagtgtcagcatccccatcataatcattgtccatatttttttcatttcttcattcccccttgttgattataggtaaataatagatgattaaatccattatttacctataatgttaccatatccctacaaggtgttgaatggtatattatacccttattttgtcattttgtttagtaataacgggagaaatgcgtatttggttggttcattccgtaaccaaagcctggcatttgctgattcggcatcatcatatgcatatcttgatatccgtatggatgatatggcatcattccatatccaccatagtggccatgatgatggtgatccttcattggaacatgtgaaaagggatcatgctgatttggaaaaggcagataggctgaatgatgatgcggataatgtccgctgtacttatcttttttaccatgataatggtttggcatattcatatgatcatgcatgtttggcgcgaccacatgctcatggttggctgtatacacattctcaaacgtatggtacgggtttccttcgtgatgatgattcattgggctattcatattgttcatttgatatctcatcctttatgtcaggttgccatatcctatgagcatgatccgtttcatgagcctatccatatgaaaaaaaaaccggcttttcagccgggaaaacaaaaagcagatgaaagcgtcaggtgctaaaatgagatgctgtgtcttcttctgcgacgcttcttacagctgctacagacacttttaggacagtaatagggatcgtagcttctagaagtatcccagaaatcgctctcaaaccaatcatcttttttatgataagacttcttttctttacatggatcaacatggcgatgatcgtcatgctttttataacagtttgagtgggaatgtttgcacttgcatttgcacattgtcatccctcctaaatgtgactcaatgctagtatatgcgagaatgagacaaggggactggatggtggcgcatcttctgcaaaaaaaggctttttctaaaaaactcaaataaaaagaattgactagtgctaaaataacatgataaaatattaatttttatccaacgataaaatgtgttataatcatattgtgaatactttcggaggtggcggatttgtttcaaataggtgataaaattgtttatcctatgcatggtgccggtgtgattgaaggaatggaagaaaaagagattttaggtaagacggaggaatattttctgattcaaatgccaaatatgcagatgatgatcccaagaggcagaatcaatcaactaggtatacgtccggtagcagatcaagcaacgctgaaagttgtgatgaacaattttgcagaagaaacaaacgacgacacgcttacttggaagcaaagatatgatgaaaatctgaaaaagctaaaaacaggtgcgatcgaagacggtgcagacgttgtcaaagatctgatgagacgaaatcagaagaaagcattaaattcaagtgaaaagaagatgcttgaagatgcgcgaggcatgttagtgagtgaaatttctcttgcacaagggctgtcacaagatgaagtcctttcagctttagaggatgaactaagagtttaatgatggatatacaataattggctgtaaacagaagggcatcccttttgtttacggctttttttgtttgaaatcagaaaaacatcttcatttttgtgggtgattttaactaaaacgaaaatgaggtcatacgatgcagtttttatggaagaagcgaatgatgcaaagaagtcagaaatacctagaacggcataaaaaaacaggaaagttctcctgattcatttaaatgagccggacaacctttgaattctgttagccattgatagtaaaataatgcgataagatgacacctaagagaatgaaaaggagcggtgaaatgaaaaggctactgatatgtggattcatctttctgatcctgtgtgctcttttaatggtgaaatgcagccattctgttcaagaaaaaaaagagcaaaagcaacatcaagaagaggtagaaaagtatcaaaaagagcgaaaaaaaggggatcaatatgacagctttaaacagcttatccggcatgaaagagaaggctatgaaatagaatttcacgaaaagggcggaagtgatttacttgtcttttcacctcatggaggggaaattgaaccaggaacaagtgaaattgtagaagcatttcaacaaagatactcgacgtatttgtttgagggaacgaaacaagagaataatcgtgatttgcatattacaagcaccaagtttgatgaaccgatattggtccaaatgattaaaacgtaccccttctccatttccatccacggctacaaaagtgataaaaggcacacgctagttggcgggacaaacgaaaaaatgcaaagagcagttgtacgagaattaaaagatcgagggttttctgcagaaatggtgcaagaaggcgaacggctctcagggacagatcctaaaaatattaataatcgaaatgcaagtggtgaaagcgttcagttagaaattagtacggcacagagagaggcctttttcgacaattttgatacgagaaaaggaaagaaaaaagcattcagacgttatatccgtgctttaaaagaagtattaagagaatttgacccatcatcgtagaaaaatcgttttgatgggtaaaaatactctatttgaacttggtaaaaaagatagaaatatgcgaaatgaacttaaaatatgcaataaattacaatttgccttaaaaacataaattatgtaaaataatagttatcagtttgatatgatagaatggggctgaagtggatggcacataaaataccatcttccgaagtaggtgtaaagatcaatcaatggtacacgcatatttgcaaatttgaagtcgaacaagcaaacgatatgaagcgccttgttgaagaagaaattcatgagatggaagaggatcaagatttacttttatattattctctaatggattttcgccatcaactgatgcttcagcattcaacgccagtccatgcagggagtgaaacacttcaagccgtgtcttttccaaaagaaatggaagaaggagaagatgagatgacaggcttactcggctattactttcattttttccatggaatgtttgcgtttatccagcgccggtacatcgaggccatttcctattacaagcatgcggaacatcaactgatcttagtgacagatgagattgaaaaagcggaattttactataaaattgctgaagtatactatcatatgaaacaaacttatttctccatgcattatgctaaaaaagcaagagacatttataagaaacatcagctttatggaaaaagaagcattcaatgtgattttgtcatggcaggtaattggattgatgtgagtcagcaccagaaagcgcttccttacttagaaaaagcgttaaaggtctgtgaagcgatggagcagaaaaagtgcacatcttattttaaagcgatggcccttaataacttaggagcttgtcattatagtatgggaacgtaccatacagcgacagtcttttttgaacaagccatttccctttatcaaaaagatcaagcatccacgatgatcaaatcattattttcacttgctctcacctggtttaagctcggagatatcgagcgggcgggcgaggctatacgtaaagggatgaatgaggcttgtttattggaagatgaaatttatcagttgaaattccaatttttgcaggcgctttatatacaaaaagacagctgtgagcaattaagatcggcactttttggactgcgaagcaaaaaaatgtttgctgatttagaggaattagcacttgatgcggctaattattataaggaacgcgacatgtacaaggaatcctccactttttttgagattgtgatcgaagcgcgtacgcacattcaaaaaggagatgagatgtatgagaacgaagcataacatgtcagctgatcaagtagatgaaagacttcacacataataacagacaaaaacaacaccctttacgaatcaacgtaaagggctttttttacttattcttttatggctttttctgcgtcaatggcacctgccccgtaaatcatcaggtcatccccagaccacttgcttgtattttcttttaacagggttttgacctcattgggcgttacatctggtgaatgctctaataaaagagcacaaataccagcgcaaatcggtgttgccatagatgtgccagataacgtcgtgtaatcatcatcgactctgcttgatttatcgagtttatctagaaaggatcttggtgatctgagggagacaatgtttactcccggtgcaaggatatcaggctttgtctccccataaacagtaggacctctgcttgaaaatggtgccacaatatcatcgttcgattctggtgtattccggtcatcaaaagcgccaaccgtaatcactttttgactgacggcaggactcgcgatcgtttggctgttaggaccagagtttccggctgcgacgcatacaacaatgcctttatcccaagcggcattgacagcacgcaccatcggatcgtcctgttcgtcatcataacgctgagcatctgcgcctagtgacatactcataatatgaatcggatcatcagggtgatcttcattgaactggatgcaccattcaaccccttctattatagtagaaagtgatccagccccttgtttatttaatacttttacgccaattaaatgagcttttggagcaggtcctttgtacaagccatctgaggccgctccgtctccagctacatctccagcgcaatgagtgccatgcccgttatcatcataaggctttgttttctgcttgactaagtccacaaaatcgcgaattcttccttctagatcttcatgcggataaatccctgtatcaatgacagcgaccgtaatgccttcccctgttaaggctgtaccgtttcggatgacttcatccgcgtgactggcttgtgtggccacatccagaagtgcatgaactttccggtctaaataaattttacgaatatgctcaccatttgctaacagctcctctaaagcagctggtgttaggtctgcagcgcagcaatcaatatgtgaaaagtgccgtttgatatttgtttttctactttttttcatgagctgttttgtgctttgaatccctgcttcgaccgcgccttccttaaattcaataatcacacgaagcttctttctcttctttaatcttccttcaaagaaacgatgaagaaagcatggcgtccatttaaaaggcttataaaggtgaaggacggtctctcttaaaggttgatccagtttactagcatgtgttctgaccatttgcaccatagaaaatccaaacatgtgatgccctccattctagctatccattcttgtacactcttacgttatgagaatgagaggtgcttggttcggattcttgtcccttcttttcttcatattggcggcttactcatttctgatgaaaaagaaaagcgcttacattttgtaaaataatagaaaaaggtggaaaacatgtagaatcagccgatgataggtgggagagttcttcttagagaaccggtgaaacaaacgattttgcagaaaaaaaggagggggtagacagggtcaatgctcatacaaatttgacttgtcacagagaggaaaaatcaaatccatataaaaagtagccaaattaaagaaaacagactggatagaactaggtcattttaaacataacttcatttgtctgtcatactattctaactctgttttcaaagaggagaggcgtttctgtgtatataaatgcaattatcttatttttgaggaatctcatcaactagagtgttatgatcaaatttgaagagaaaaagtggaaaaaatgaaaagaaatgatgattcaatataaatcatagaaacggcttagaaatctgttaaaggagaacgggaatgaagaagttttttgctttgcttctcctgcttgcgatcggatggggcgtttattatacaatgcaagcacaggaacatgatgagccagtgtcatcaggtggggaagacgaaagcggttcaaatgatatttatcgcaattttaaagaactagaagaaaacgaatcaacaagcagctatcagattacatccaacccagtgcctggaagccgtcttcttgtgatgtcaccccatggggggagaattgaaggcggcgtgagcgagatcgtccatttttttgataatgatttctctacgtatttgtttgaaggtttaagagagaatgcgtcagaacttcatgtgacaagtacaaattttgatgagccagtcggcgtcgcgcaggcaaaagcacacgattatatcttagcagtgcatggctacaaaggtgaggaaggcattgaccatacactcgttggcggaacagattacgaccgtgcagagaaaatagtgaactcattagagcggaatggattttctgctgaactggctgtcgcacacgcaaccctgagtggaacaagcaatcataatattaataatcttacaaaaacagggcaaagtgtacagctagagattagtagaagtcagcgtgaagctttatttgacagttttgactttcggcggcggtcgagtacaaaaaacgagacgttctaccggtatgtcagggcgattcggacagtgcttgatgaggaatatacataaaaatggtgcacatgttaagacaagcagcgtgaattcttgttacactataaaaagtgataacaaaaggagagacgaatatggcgcgtcatcattttcatcttcgggcgagctggcctggcctgcgtaacggtgtgggtacaatctcatgcgaacagttaaaaacgaacatttcaattccaaaagaaatggatggtcccggcattgggacaaatccagatgagatgctcttaggtgcagcggctacgtgttatattattacacttgccgctatgatggagcggagccaattagaaaaagaggatctcacgatgagttctgaggctgtcgtcgatgtgacaaatggtgtgtttacatatgaaaaaatcatacatcggcctgtcatcatcctcaaagcctctgcttctccgcaagatattgagcttgcccgcaagcttgctcacaaagccgaaagctcatgtatgatctcaagagctgttcaaggaaatgtggacatttccttagaagaaaccattcaagtcggcgggtgaaaacaaaaagtcattttctcttaatgaaatggagaaaatgactttttttatgacgtccattcggtttgattgatatgttctttgttttcttccttttgtttttttgacaggttcaagacaatcacaccgcatattactaatgcaagaccaatgaagccttttatgtgaatggtttcgttaaatagcacgagtccgataagagcagtgagtgctgttccaacgccagaccatgtcgcataagcagacgaaaggtcaatcgttttaagtgctagactgaggaaggtaaaggcacacccaaatccaatcaggaccccaatactcggtaatagttgcgaaaaaccttgtgaaagcttcagcatcgtactgccaaaaacctccgttaaaatagcccctgttaaatagagcattcctttcatgatctctcacatcctttatgacatatttaaaagtacgacccctgagacaagcatagccatcccaatgattgctctttggttcaaggtttctttgaaaaaaagcacgccaaaaatagccgtgaggactgtaccaaccccagaccatgttgcgtaagacatgctaagtggaatgatatttagtgtcaatgacagcatataaaaggcaagtgtatacccagcaacaacgacagcgctaggcttaaagcgagtaaagccatttgagaattttaacatcacggcgccaatggcttctgaaaaaatggccacagctagaaaaagatatccgaggatcatcatgttccctcctctaataggtgtaaaatccggtgaagtaaaagggttttttcctctcggttcagcggttcaagctgaaacatttctgaaaaccatattccatcacatgcaagacggatcagctggctcaatgcagggtcattaatttcctcagctgctttcgctttgaactctgcataaaaatcacgccaagggttcaataacgcttcatcaaatgacatagtagccagcatacttgtacatagctgaatcgtattttgatgatcaagatcatgtaatgtggccgatatatatgcacggacataaggtgctttttcatgtttgtaagtttcttgatacgtttcgagctgctgacgaaagcaaagaatcgcgtgctcattcattttttggatgagctcttccttgcttgcgaaatgataaagcaggccggctttggtcatatgtgcatgctctgccacttgctgaagggtaagctggcttaatccttctactaaaatcgtgcgggcagctgcatcaaagatttgctcttttttggttttagacataaaaaaaaacacctactttactgaacggtcggtaaagtaaatgttaacccatcaaaaacgagtgtgtcaatcgattcatttgatgaacagattttttcgctaaatcgtcatatttaataataagggtatggtccatatggcgggtacggaggcggataagggtacccatagccatagcctggtgcaagcagagacccagcaagcagacctccagcaaaaccacctaaaaatggaggtccgaaaaatccaggtctaccataaccgaatccaggtctcccaaacccaaatccgggtctcccaaacccaaaacccgggcgtccaaagccaaaaccaaaaggtcttctcatgtcttcttgcataaatggctgtgcatcaaaataattcataaaaaaaggctcctctcacataaaatcactgtaactgacatcagtgtattcgattggcctatatgtgtttgggtgaacgcctattataaggaggaatgttaaaaatgggcctgtatccgtctgattgggctaaatgcccgccgcatgctcatgcctataaagcacgaacggatgtaacagaagagcattatcatttaatagaaggtatttctcagcctgtcaatggaagcagtaccgatcagcatactcattactatcgcggggtcacctcttttgagagaggacatttccacagatactacggcgtcacaggacctgcgataccgagattggatggtacgcactatcacgagattgaggaagtcacgttttctgcctataacgactctgtccctattccatacggaggagtcgtctatagtccggacgaggagcggccgacgcatgcgcatcgcttaaaaggaaagacgtacgaagtggtcggaaatgaaccactcggctggtgatagaccttatataggagagtaagagaagttatgctatactgtaggcagtttgtaaaagagagtgatgttatgaaaaaaacgaaacaaccagtgattgtattagtagggccgacggctgtcggcaaaacaaaactgagcattcatatagccaaagcatttaatggagaaattatcagtggtgattctatgcagatttataaaggaatggacattggaacagctaaaatcacccctgaagaaatggatgatgtcccgcaccacttaattgatattaaagagccagatgaatccttttctacagctgaatttcagcagctggtccgtatgaaaatcaaagagattgccgctagaggaaaaacacccatgatcgtcggcggaacaggtttgtatatccaatctgttttatatgattacacatttaccgatgagaaaagtgaccctgcttttagagaagaaatggcgctgtttgagcagcagcatggctcccttcagctgcacgaaaaactaaaggcagtagaccctgatgctgcaaaagccattcatccgaataatgtccgccgcgtcatccgggcgcttgaagtgatccatacaacaggtcagaaaatatcggaaatgcaaaatggtcatcaagaagttcctctttatgatacagccttcattgggctgaaaatggatcgagagcttttgtacgagcgcattcacaaaagaattgatatgatgatagatcaaggcttaattgaggaagtgagcgcactttatcaatctggcttgaaggattgtcaatcagttcaagcgattggttataaggagctgtatgcgtatttccaaggtgactactcacttgatgaagctatccagcaattaaagcaaaattcccgtagatatgcgaagcgtcagttcacgtggttccgtaataaaatggatgtcacttggttcgacatgacaccgccttgccacttttcagacaaaaaggaggaaattttcgcatatatagcaggaaagcttggacttaaagcgaaactgtagttatcagaatcaaggaggacgaaacatgaaaccgattaatattcaggaccaatttttgaatcaaattcgtaaagacaatacatttgtcacagtattcttactgaatggctttcagcttcgcggtcaagtgaaaggatttgacaatttcacggtgctgcttgaaacagaagggaagcagcagcttatttataaacatgctatttctacatttgcacctcaaaagaatgtaaatctagaattagaataggatatgttcgacctaatagccccatgcatctgcgaataaaccggctggaacccgctacgtttttgtcagtgcagaggggctattttgcatgccgtgaaacctttctgtctattttgcgtataatcccttattggatatgaagaaaggtgaggggaacgatatggaaaatgcagagcttgaattaagaaggattagagtgatccttctactaattgggattgttgtcttatttggatcgtgcgccatttcaaacattgaatctaggcaggaaagctggcataactattctaatcaagatgatcatggagatatagaaggtctgttacaatcagctgttgcactaaaaaataatcactttgctgttgtgaaagatgatgaagtacatgtgtaccggtttgatgaaaaagagggagaactgacccttattaaaacaaaatacatagatgagtgggacgaagattatgatgatgacgattctgtggaagagtaagcacgtaaatttacaaatgaatgtgaagtcgctacactataatcatgcattagacatctagacagaaaaggatgagttcatgacacacaaaattaaaattaatcattgggaacaaacttgtgaagacgactcctgcttcgaatatggaacaagtgtttctgtaaatgggaaagaattagtcagagaagcttcaatcgtctctgcgcttgaagcggtgctaaaagaattaggtgttgaagtggaaattacagaagtgtcagaagatttacagtgcgatgcctacaaaaaataaaacaaaaagtctagtctactaagcgattttttttcgtgttatgatagatttcggtttcagttgaatagagagtagagcagtctatttttagatcctgttctgctctatttatttgaacgtacgagttcggctatgaatgttcggccgggttggttgatttttttcgtttcgaacatctatatattgtgttttgaaaaaacatagtatactatatatagtgaataacgaaatgatcaacaatactaaaaactaggtcgtgatggaattgattcaaatcgtatttgattcaaaaacaggaaatgttcaacgctttttggacaagaccccctttacagacaaacgaaaattgactggagaagagtttttggatacgccgtttattctcgtcacctttacgacaggatttggacaagtccctagtaccactcaatcttttttagagaaaaatgctcaccttttactaggtgtagcggtgagtggaaacaaagtgtggggagataattttgccaaaagcgccgatacgatttctaaacaatatcaagttcctattttgcacacctttgaactaagcggaacaaaaagggatgttgaattgtttacacaggaggtagaaagaattgtcacaaaatcaggttccaaagtggatacaattaaataacgagattatgattcaaaaagaaggaaagtttcagttcgataaggacaaagaagctgtacatagttatttcgtagattatattaatcaaaacacagtcttctttcacaacttagaagagaagattgattacttaatagaaaacgactactatgaagaagaatttttaagacaatacagcatggcagatattaaagaggtattcgaagctgcatatgcgaagaaatttagattcccatcattcatgagtgcgtttaagttttacaatgactatgcactgaaaacaaatgataaaaagaaaatccttgaacgctatgaagaccgcatttcagttgtagcgcttttctttgcgggcggagataaagaaaaagcccttgagtttgtagaactgatgatcaatcaggaataccagccaagtacaccaacattcttaaacgctgggcgtaaaagacgcggtgagcttgtgagctgcttcttgcttgaagtgaatgactcattaaacgatatttcaagagcgattgatatttcaatgcagctttcaaaattaggcggcggcgtcagcttgaacttgtctaaacttcgtgcaaaaggcgaagcaatcaaagatgttgaaaacgcgacaaaaggtgtcgttggcgtgatgaagcttcttgataatgcattcagatatgcagatcaaatgggacaaagacaaggatcaggcagtgcgtacctcaatattttccacagagatattaatgatttcttagatactaaaaaaatctctgcagatgaagatgttcgcgtgaaaacattgtccatcggtgtcgtcatccccgataaatttatcgagcttgcaagagaagataaaacagcttacaccttctatccgcacacagtctataaagaatatggacagcatcttgatgagatggacatggaagaaatgtatgatgagcttgtagaaaacccgaaagtcaaaaaagaaaaagtcaatccgagaaagcttcttgaaaaattggctgttcttcgttcagaatcaggctatccatatatcatgttccaagataacgtgaatagagagcatgcattaaaccatatttcacgagtgaaattctcaaacctttgctcagaagtgcttcaagcttcagaggtctcttcttacgcggactatgatcaagaagatgaaattggtcttgatatttcttgtaaccttggctcattaaatatcatgaatgtcatgaaaaacaaatcgatcgaaaaaacggtcaaactagcaacagattcactaacgcttgtatctgaaacaacagatattcgcaatgcaccagctgttcgaaaagcgaacaaagcgatgaaatcaatcggacttggcgcgatgaaccttcacgggtatttggctcaaaaccaaatcgcctatgaaagtgaagaagcaagagacttcgcgaatacattctttatgatggtgaactactattcaattaaacgctcaagtgagcttgcaaaagaaaaaggagaaacattccatcgttatgaaggctctggctacgcaacgggcgagtacttcaataaatacgtggagaatgatttcacaccaaaaacagaaaaagcagcagcattatttgaaggcatgcatattccaacaaaagaagactgggcagcactcaaagactttgtagcggaaaatggcatgtaccatagctaccgcttatgtattgcaccaacaggttccatttcttatgtgcaatcggcaacagcttctgttatgccaattatggagcgtatcgaagaaagaacatacggcaacagcaaaacgtattacccaatgccaggtctttcagcgcaaaactggttcttctataaagaagcgtacgatatggatatgtttaaagtggtcgatatgatcgcaacgattcagcagcacgttgatcaaggaatcagctttacactattcctgaaagatacgatgacaacgcgtgacttaaaccgcatcgatctgtatgcacaccataaaggcattaagacactttattatgcaagaacgaaggatacagggcaggaaggctgtctttcttgtgttgtttgattaaaggagagtttaacgtgacaaaaatttatgatgcagccaactggtcaaaacacgaagacgattttacacaaatgttttacaaccaaaatgtgaagcagttctggcttccggaagagatttccttaaatggggatctattgacatggaaatatttaggtgaaaaagagcaagatacgtacatgaaggtacttgctggactgactttacttgatacagaacaaggaaatacagggatgccgatagtggctgaacatgtagaaggtcatcagcgtaaagcggtattaaactttatggcgatgatggaaaatgcggtacatgcgaaatcatactcaaatatcttcatgacactcgcaccaactgaaacgatcagtgaagtgtttgaatgggtgaagaagaataaattcttgcaaaagaaagcagatatgattgtcagtttataccgttcaattcaaaaggacgatccgatttctctctttaaagcaatggttgcttctgtttatttagaaagtttcctattttacagtggtttttactacccgctttatttctatggacaaggtaagctcatgcaaagtggtgaaatcatcaacttgattttgcgtgatgaagcgattcatggtgtatacgttggactattagcacaagaaatttacaacaaacaaacacctgacgtgcaaaaagagctatatgatttctcaattgacctattgaacgagctttatgaaaatgaacttcattacacggaagatatatatgaccaagtcaatttatcgcatgatgtgaaaaagttcattcgttacaatgccaataaagcgttaatgaaccttggatttgccccttactttgaagaagaagagatcaatccaattgtattgaacggactcaatacaaaaacaaaatcgcatgacttcttctcaatgaaagggaacggctacaaaaaagcgacagttgagccgttaaaagatgacgatttcttctttggggatgaatcataagtaaggcgtaaaagtcaaaacgcatcactcgttttggctttttgccatttcatacaatgcgttacatactggaggttaccgaacatgggaaaaatggatgaaatcatactagttgcaccgcgcacacgcgtattccaaaacgaaacgcttgcgtttaatggtgtgaatagtgaagagaaaacaatcaatacaatgatgaaagaaatcgaagagcacttcgagcagatgcgcagaggcgatgcggaagaaaatcctgacttcaagcagccgattccttatgtcgtgattaaacgtgaagacgaagtgtatgtatatgaaaggcttcaaggcgggggagagactcgattgcatcataagttatctcttggctttggtggtcacatgaatttcatcgaaggtaaaaactttgctgaaattctaaaagaaaatacggatcgtgagctagacgaggaactttctattcaagaagaagacaaacttgagatgaaaacccttggattaattaatgatgatgacaacagtgtaggccgtgtgcacattggactgttatcagcgcttgaattatctccaggtgctcatgtagaagtgaaagaaacagatcaaatatcaggaaaatggatgaaagcatctgatttgaaaaagcctgaatacttcaatcgacttgaaacgtggtctcaatttgtcgtgaacattttagcataaatgaagcaatcaaaaaccggctcagcagcagacttgagccggtttatttcgttataacagcttcagttattggaaaacgaatgcgtcgtgacctgcctgtttcaattttgcaacgaggtcatccgcattttgctttgtacgaaaagctccggcttgtactcggaacatgccgccctctaatacaacgaaggcgtcaaagcctttggatttcagtgtggctgctaactcatctgcattggctttcaccttgaaagctccagcctgtactttataaagattacttgctttttctttcagctgaaaggctttctctaatccagtggcatgagcgtgagcgatgccttgaaggaaggtcgcgttacgaagcttatttgcatcagctgtcgtgtcaatgaaaccattctctgttaaaatagcgggcatagaagtttctcgaagaacgtggaagttcgctgttttcttgccgcggttggcaaaatccactgagcgaacaatctcatcatgaagggcattgcgatacgtggtggtcggtgctgaaacgccaggatacacatagctttcaaaacctgtgcccccgcctgcattaatatgaatagatacgaaatagtcagctccccagctgtttgctgcattagtacgctgggtcaaagtgacggattggtcaattgaacgacttaagcggacggaaacatcatcataatcactaatcaacatatctctcaataaaatcgcgatttgcagggtgatatttttctccaaaagtccattcgcagcagctccagaatctgttcctccatggccaggatcaataaaaattttcaccatctattcatcacctcgtctttattttatgagaaattagaaaaattgcctgtacaaaatgcggaaatcattgagactcttttctgcacaatttgtgatgagaaagctacatttttctaagaaaaaacaaattgttggtttgtccgcctaaatgggatgaatacaatggaaatagcacatcatttcctgggaaaccgcagaaatccctacaatattcggtatctcgggtcattttgacagcaaacttgggcttaagcgggcgattgtcacgattacagctccacccgaatagaataaagagagaagagcgagaggtgaatacgttggagcgagctgtcacatataaaaacaacggccaaatcaatattatacttaacggacaaaagcaagtattggttgatgcagattcagaggcagaataccttgaagccttgcagaaaaatgaggcgaaacacagcatcttacgggaaatagaacgtgaaatgaacagccttgtcggtatggatgaaatgaaacgaaacataaaagaaatttatgcttggatctttgtcaatcaaaaaaggcaggaacaagggttaaaggtaggtaaacaagcgcttcatatgatgttcaaaggaaatccaggcacagggaaaacaacggttgcaaggcttgtcgggaaacttttctttgaaatgaatgtcctttcaaagggtcacttaattgaagcggaacgcggagatctagtcggggagtacatcggtcatactgctcaaaaaacaagagacttaattaaaaaatcactaggtggcattttgttcatcgacgaagcctattctcttgcccgcggaggcgaaaaggattttgggaaagaagcgattgataccctagtaaagcatatggaggataaacagcacgaattcattcttattcttgctggctactccaaggaaatggatcattttctatcattaaatcccggcctgcaatccagatttccaatcaatatcagctttcctgattataccgtcgatcagctcatggacattgccaaacgaatgatggctgacagagaatatatatttactcaagaagctgaatggaaactgcgagattacttaatgcacattaaaagcaccacgagtcctgcaaaattcagcaacggccgctttgtgcgaaacacgattgaaaaggccattcggacccaagccatgagactcctgcttgtggatcattatgataaaaaagatttgctgacgattaaaagtcacgatctccaaatgaaagaggatacgcctacttaaaatggcgtatcctttttataaagagatactaaaataaaccatccgaatagtggtatacgtgtgatgtgtttggtatgatggtactactgaaaacttaagtacagaaaggaaacaactgacgttgaatgaacatgaaatgacagaaaaagcgatccttgtcggctgtcaattgccgcatgtcacggatgaacgctttcaatactcaatggaagaattagcttccttaaccaaaacggctggcggtgaagctgtcagcgtaatgacgcagaagagaaatagacaagacagcgcaacatatataggtaaagggaaagtggaagagcttgaagtgctttgtgaggaatttgaatgtgatgtcattatttttaacgacgaactgtctccaagtcagctaaaagctttggcaactgccttagatgtgaaaattatcgatcggacacaattgatattagacatctttgcaaaaagagcccggacaagagaggggaagctgcaaatagagcttgcccagcttcagtatgccttgccgagactaagcggacaagggatcagcctctcaagacaaggcggcggaattggcgcaagaggtccaggtgaaacaaaacttgaaacagatagacgccatattcgaaaccgtattcacgaaattaacgggcaattatctacagtcaaagaacaccggacaagataccgggaacgccggaagaaaaatggtgtgttccaaattgccattgttgggtatacgaatgccggaaaatctactttgtttaaccaattaacagatgcagatagtcatgaagaggatctgctgtttgcgacccttgacccaatgacacgtaagatgacattagcatctggctatagtgtgctgatttcagacaccgttggttttatccaagacctcccaacaacactcattgcggcatttcgttccactcttgaagaagtgaaggaagctgattatttgcttcacgtcattgattcttctaatgaggattacgaaggacacgaacgaacggttcatgagttattagaagaactagaagcagaccgtataccgatgctgacggtttataacaaagaagatcaaatcagaccggatttcatcccatcttcaaagcatcgtcatcttttaatcagtgcgagacgcgaagaagatataaagcgattaaaagcggatattatggcagaactgaaacaaaactttttaaaaccatatcatgtgaagattccagcgtatgaaggaaagctcatctccgcattaaaatcagaaacgctcgtggaatcactagaatttcaaaaagaagcagaactttatgacatcaccgggtttagcggtgaggagcagaccatattaggtcaaatcaagaagtatatgttgtaagaaaggaattaaatcaagatgtttcatacattaaaacacggcagtattttagaaaaagtagcagcagaaacagaacaagagattttacacatgcatcagcaaattgatcaaaagagtgaacaaaatgagtggcgggtgcttgaaagctaccgaaagcatagagtcagtgactctcactttaacccgacaactggatatggctacgatgatatgggaagagacacgctagaaaaaatttatgcggatgtcttcggaggagaaagcggccttgtgcgtccacagatcatttccggcacacatgccatttccattgcattattcggtgtgctgagacctggcgatgagttgatctatatgacgggaaaaccatacgatacgctagaagaaattgtggggattcgcggcaaagaagggacaggctcattaaaagacttccagattgattacaaggccattgatttaaggcaagatggatccgtcgattatgacaaagtaaaagagtcaatctcctctaaaacaaaaatgatcggcattcagcgttcgaaaggctatgcgtcaagaccttcttttacaatagaagaaattgagcaaatgatttcatttgtaaaagagatcaatgaagaaattattgtgtttgtggacaactgttatggtgaatttactgaattgcaagagccatgtcatgtgggagcggatcttatggcgggttcccttattaaaaacccaggcggcgggcttgccaaaacaggcggttacatcgttggaaaagaaaaatgggtagaagcttgctcttatcgaatgacatctccgggcatcggcagtgaagcgggtgcctcgctttatgcgcttcaggagatgtatcaaggatttttcttagcaccgcatgttgtggcgcaaagcttaaaaggtgcagtgttcacggctcgttttcttgagaagctcggattccaaacgaacccagcgtggaatgcgaaaagaacagatttaattcaatctgtcgaatttggagatcctaaaaagatgattgcattctgccaagcgattcaatatgcatctccgatcaacagtcacgtcacgccgcatgcaagctatatgccaggatacgaggatgatgtcattatggcagcgggcaccttcgtccaaggagctagtatcgaattgtcagccgatggaccgatcagaccgccttatacagcctacgttcaaggcggactcacatatgcccatgtgaaaaatgcgatttgtagtgctgtagatgccttattggaacaaggtttcatcgacatacctgctcaataaaaaaaccatgttaatattcctaacatgttgttgacacataatataacatgacatataataaatttaagcaaagaggaggagacagttgagatgagtgataacattcgccgctcaatgcctttattcccaattgggattgtcatgcagttaacagaattatctgcaaggcaaattcgctattatgaggaaaatggattagtatttccagcaagaagtgatgggaatcgccgattattttctttccatgatgttgataaattactagaaattaaaaacctcatcgaacaaggtgtaaacatggcaggaatcaaaaaactttttgccaaagctgaggcagaacatccatcttctgatgtaaagaccgaggagaaaaccacagcgaagcacaacttgacagatgatgaactcaggaagctactgaagaaggaactcattcaggctggacgtttccaacaaggaacgacctttaggcagggggatatgtcaaggttcttccgttaaccaattagcaaaagcattgctatacaattttaccttttgtaggggaggagttttacgaaatggcaaaatacacaagagaagatatcgtaaaattagtaaatgaggaaaacgtaaagtacatccgtctgcaatttacagacattctcggaacgattaaaaatgttgagattcctgtgagccagttagaaaaagctctcgataacaaatgtatgtttgacggttcatctattgaaggcttcgtacgtattgaagaatcagatatgtatctatacccagatctcaacacatttgttattttcccttggacagctgaaaaaggtaaagttgcacgctttatttgtgacatttacaagccggacgggacgccatttgatggagacccgcgtaataacttaaagcgtgttttaaaggaaatggaagacctaggatttagtgatttcaaccttggacctgagccagaattcttcttatttaaattagatgaaaaaggcgagccaacgcttgaactaaacgataaaggtggatactttgaccttgcaccaacagatctaggtgaaaactgccgccgtgatatcgtgcttgagcttgaagaaatgggctttgaaattgaagcgtctcaccacgaagtagcacctggacagcatgaaattgacttcaaatatgcaggcgccatccgttcttgtgatgacattcaaacattcaaacttgttgttaaaacgattgcgagaaagcacggacttcatgcgacattcatgccaaaaccattgttcggtgtaaacggatctggtatgcactgtaacctatcattattcaaaaatggcaaaaacgcattctttgatgaaaaagcagatttacaattaagcgagacggctagacactttatcgcaggtatcgttaagcatgcaactagctttacggcggtcacaaacccaacggtgaactcttacaagcgtcttgtacctggttatgaagcaccttgctacgtggcatggagtgcacaaaaccgtagcccattaatccgtatccctgcatcacgcggcatcagcacacgtgtagaagtgcgcagcgtagacccatctgcaaacccataccttgcactaagcgtattacttgcagcaggtcttgacggaatcaaaaacaaactagacgcaccagcaccaatcgacagaaacatctatgtcatggacaaagaagagcgtcttgaaaacggcatctctgatctgcctgcaacacttgcagaagcacttgagctgctcaagtcaaacgaagttatggtcaacgcactaggcgatcacttattcgagcacttcatcgaatcaaaagaaatcgaatgggatatgttccgcacccaagtacacccatgggaacgcgatcagtatatgtctcagtattaataaagaaaccccttggagccattggcttcagggggtttttaaaaaggatttggtggtcaaatttatagtgaccagaatcaaaatgaagattgaccactttttgaccaccaaattcaacagaaaatttcaaaagcaaacaaaacttttagatcaaataaatcgatattcactccatgactgtgagttcggtaaatcaaaagttaaataacttagtgaacagatgcaaaatgaacagcttgttttagataaattcctaaaagatcgtgaaaactccaagcgtaaagaagcgctgcaatatcagcttgaaaaagtcggaaaatcaattaacgcaaagtatgatgatcttattaatgctgagcatgggttcaaggatttagaaggcggcagacgaaaagaagaacgtatcagccactattgcttttattacaaatattcgtcataaagatcgagatcgcttttatcaaaatgctgaggaaaatttatataaattgatagaacctatgtattttaagatgaataatataaaaaatataaaagatgatcaccataaggttgaatctataagaaagtttttcaatacttataatcctgaaaaaataaatgtttcaaagcttggaaatagaaaattaataaacagatttagagaaacacattcagcttacagtcactatctaaccgaatttcatgatcaaagtaagaaattcttatttcttaaagttaaaagtttggaatattttttagataaatagtattggaagctctttgaagctatatataaggatcacgattatttcaagagaactgtcgacatgaattatctgttccgctttttttatagaatctctatttttattgaaagtacgttctttgctattagctggaaagtagttgcagttatcatttttgcaatgatggatgaattttcaaaggaaagcatatggattgaagattttaaactaaaggtactatatctactattgtttttctgtatttcgcaattgattctatatatatcttcgatgagtaacttggctgttgcagatgacataaaacaaaagaaaactttctacgattatttaatactgtgcttaacttatttgtggaaaaaggcttcattgaaatgtcgagagctaaaaagagagaaggctattcgtgaagaagaaagggaaagcatggagctcttagaagaaaacgatgaaactgaaactgaaagagggtgaaaatatgccacgagaattgataaatgcaaaaatcacacacgtttcatacgtgaacaaggctgctaatcaaaagcagttcttttttatgaaatcagaaaagcagccagactttcaaaaagaaatcaaggtcattgccaaagcagatgatgcacagcatcttgtgtacgttattgtatacaaaccaaacgtagcagatgaactggggattacatgacgccggcggagattgaaaaagccgctcatgggttcctgaaggatgcacgtgagatcgacaagcagcatgatttccaaggcggtgtcggggaagtcgttgaatcgtacattgctccgtctgactttgaaatgggcgatgagctgatcaagaaaggatcgtgggtccttgtgacaaaggcttctgatgaaatctgggaacagattcaaaagggtgagatcaacagatactcaatggccggaacagcggatataggtaagcaacagcgtgagctctagcggaggtttactactacctggataaagaagcaaaaaacaacggtgttgatggatactgtggaccaaaaacagcaaattcaataaaacgattctaattgatgcatggtcttgctactgacggtatttatggaccgaagacaaaaccaggtcttcaaaaagcattgaaataagtaaaaccactgtcctttttaggatggggaatttttttgttcgttgattagtaacatcgaacaagtaaactttctaaaatattgttaaatatctaaagcattttcaccaattaaaaacatacatatacctatataaattcaagatttttattgttaaaataaggtttaataagcaatatcctagtgtaattactttttttaacaaaaatatttaaaatgttctctttgcctgagataatcaaataaaatgaatagtgacagggggtgtatgtttgccggaaaaagttgaaaattcatttgtttaaatcccttttgattaattcgacctaatgaatatattgtcttttataccataatattctataataatatataaatgtagaatatagacctacaagatcgttaaagtgttgattatcaaattacgagtccgggtcgtaattttttaataatacaattcaaaggggaaacaaaatgaagagatttataacaagtttgaaagtctttgttgctgtcttattattgtttgcgatcacacccattgtagcaaccgcagaagaaactaacgatcaggatttaacgtttcaaaaagcaacggatattgtaacaaatgaagacatagaaaactacaaggctttaagtgaagaagagatcattgatcgaaagacagcgattagtgagggttatgctgaaggtgatgttttatcaaaagaagatgccttatttttactaactgaatcaattgttgaacgtcaagatcaaaacggagagctttcaactctagctggtaaatcatcaagaagttttagtacctcaagaaagaaatatggaacaaaagtaactttaaaaggcacaatgtatcaaaatattgcgttcgttgcaggaacatcatcgtttcgtggaaatattaaagcaacacgaaacagtgggaagctcaagcagatcaccctacttacttaccatgattcattcggtgtcgtaggatggaacggagggtggccatctgttggtaaagtatatggtggaaaagtcagtaataaaaaagttgccaatgccaaaacatatgcaatggataaaacgcatcgttacaattccgttttgcctgtctacaccactatgtggccaaaggcagctgtgaaaacaaagtcaggaaatgcctatgatgtagcttctaaaacttggactagatggcactaatccttaatgaaaggagatagtaaatatgccttggaatacaattatcactgccggtctatttgttgtgatacctgtagtcattatcacagtagtagtttactttattaaaagaaagaacaccaaaacatctaatagttgattactttaaaagagccgttcattttaattcggctcttttttatattagctattcaaaattgctccccaataaggctttactatatcaaaacgccctaacttttgcggtttctttttcggtgtggaattatttcttaaatgacaatatatttcattatagggaatattaaggaaggggtagggtcttatggagaaagtgctttcttctcatgtcgggttgaaaatcaatgaatggtattaccatattcaaagatttaacgtttcggatgccgaagcgtataaggaagaaataaaatctttgctcgataatatgaaggaaaaccaggatttattattatattactctcttatggaattccgacataaattaatgttggattatttgaatccattggaaaatggaaaagagcgtgccaattttagggatttagcaatgaagattaaaaaggatcaagagaaattaacaggcttgcttgattattattttaactttttctacggcatgtacgaatttgaaaactatgaatacctcaacgccattacattctacaaacgagcagaaaaaaagctatctcttgtaagtgatgatattgaacgtgccgaatttaattacaagatggctgaaatctattaccacatgaaacaaaaccacatgtccatgcaccatatagcccaagcaatagaatgttatcgtgaaaaagatacttatactgttagacagatacagtgttcctttgtcattggattaaactatattgatatgggctgccccgaaaaagcaaagcctcattttgaacacgcactagaaaaagcaacggatagcgacaccaaaagattagaaggatcagcgctgtataacttaggattaagctatttccacaatgatgaaatagctgctgtaataaaatatataaatgactcgatcaacgcttttaaagaacgaggatatgagcattttaacagaatacttgatcctttaagtatgcttgtaaggtcatattttcaatctcatgaaaacgatctaggcatatacgctctcaaccagggcatagaattggctgaaaaattaaatgatgacgtgatgcttaaagtattcactttttacaaggcgctttatgtgaaggaagattatgataaagtgttgagtgataccgaatatttaaccgaaagaggaatgtatgcaattcttgaagaattatcgaaagatgcagctagaaggtataaaacagtaggagataaagacaaggcgtcgaacttctatgagaaggttctttacttccaacaattaataaaaaggagtagttgcaaccctcatcattattggcactttgagcacgcttggttatttcgtcttttcacaaaaccatgaagaagctatcagaggacacacatcaagtatcggttatgataaattccattagaaaaaagccctttttagggggcttcttttttatttgaacattatttttctaaaatccttgaatctacaatcctttttcttttccccgttgctttattgaatgattcaaggatatacaaaaatgtgttgtcggtacatggtttaacattaattatgttttccctactgttgtaattggttaaaaaacgataaagtggattaaagtgtcaggctccttatggtattctagtaaaagaatattccataaaaggagtcttttttatatgaaaatattagatgctccatctttactttcagctgtcgaacagaggtcaaaggcctatcatgagcttcaagaagagatgaaacttgtgaaaaaagcattaaaaggtgtatcgggattaggtgatgggtttactggaaaaggtgcagataatatcaaagctttttataatgatcttgcactatacacagacacttatcttgattttatcgatatgcaaaaggcttttttagatggagtgaaaggaaagctggatgatgaatcattaggcgggagtacatttattgatgaacacttcctagatgctcaattgaagcaaggcattcagaacaataaagatatggtcaaggaacaaaaagaagctctatcaacgatttttgacgatattagtgatttgattgaattacagacattttccagcaaaaaagtagacgagcatttagatgatgcgaataaaaaaagaaaagatgcaattgaggctatacatacattagatcatgttctaaaaacagaatacgaaaaatcagaagccattgagaaacatcttgctactttttatacaaaaatgatggctgctacaggaaaaggtaagaacgctcagcccatgtattatgatgcaaaagcatttcacgagacagatgtgtacaagaatcatgataaaattgatgcacaggtgaaagcttacttaaaagtgaaaaaagaagaaaaagagaaacgaagaatcaaagaattgaaggaaaagctcaatgatccttcgtgtatatcagtagagaaatactttgagattgtagacgaaattggatatgaaaatctttcttacgatcaaaaattgtattacagtcagcttctccagatcaaagcgcaggaagaagcatcagaggtattcgttgacagtgtaaaaggtgctgcagttggtctatatgatgtggcaaaagatacagtggttggcatctatgatcttgtaacagaccctgggggtgccgttgaatcggtcgtaacagctgtttcacacccaattgaaacatcgaaagcgattggaaaagccatttcagactcattcgaaaaagaagtcatagatggtgatgcgtattcacggtcacactggttcgcctatgcgacgggttcactagcagaaattgtctttggttctaaagggacaggagccatcacaaaaacggggacaacggcggcgaaaactacagtgaagaaagggcttgaacaaggagcaaaatcattagacagagtttctattccgaatctattgccatactcacctaagtttcaaatggctggtagcccgaagctgccgtataacgtgtttgacggagaaaatcttaaaaataaactcctctccatggcaaagcgtctagacaacaattcaggatacggaatctctaagacaggcagacgcttaccagcacctaaatcaccaccgaccgttgtcagttacggagatcactatgtgagatggaaacgtaagaaagtattaaagcctaatgtcgtttattcaactaaacaaggttacacctacacaaccgatcactacggaagaattgtcaaagtcgaagcaagtgatttaaaatacggagaggtcaaaagaaaccaatatgcccaatccaattcaggaaagccggatcgattatcaaaagatgacggaggtcacttgattgcctctatttttaaagggtctggggatattgataaccttgttccgatgagttcacagataaatagaagtggcgggaaatggtatgagatggagcaacggtggttgaaagctttgaaaaccgatccacctaaaactgtgacagtttcaataaaagcattttatgaatccgattcgttaaggccatctgaattcctagtcaaatacaagatagacggaagagtttatacagacacaatatataacagaccaggaggatgaacaaatggaaacaaaagagatggaaagcttatatagagaaatagctagaaatttaaatgaaatgattccagtggaatgggatacaatttggatgtatgcagaaatgttagatgactccgcatctgctctcttttattttacggttcctaataaagaggaatatttttattcacacaatatcccagatcaatatcaggttagtgaagacacatatgatagcctgttgattaacttacaaagaaagctaagacagttgagggaagagtatactaaagaacaatcagataaatggacaaccgtaaaaatgaaattgacttattcaggaaaaatgtcaacagattttggttacgatgatgtattttctttaggtattgacaatatacagagaatagcagtttgggaatatgaaacgtttggatttttacccgatgatgaggaagataaagaagctgtgctaaattttataaaaaataaagaagaaaacaaatagtacattaccctccaaagacaggagggtttttgtattagatatgaattggttctagaaaaagtagactaagaggatacaacttgttcagactgatttgtataaaaatgtgccacatattggtgcagcatcagacttaagaggaggctactaaaaagagttttaaacggattaaagacaaacttgatcaatacactattgatatcagatcaaccaaaacaaatagctcattatacgaaatgaataaaatagaagaagaaaacggatatcacatttcttctgattataaaagttttattaataaatatggagaatgttggattgaggacaatgtatatacctctctaagagaaaaaccagtgtggtttgttggtgaatcagtgccagtcgaattgttttatgggttggagcaaaatgattatgatataagagaagccataaaaacatataaagaacaattatcagaacaaataattcctatcgcagacgcagacgacggagacctaatttgtttagatgttagtgaaataaatcaagggaaaatttatttttgggatcatgaacttagagatagagaccaggatctgttcctgattgctgatacttttactgagtttattgaagggttatttgttgttgaagatgatcatgaagatagtgatacagaagatattgctatccaacttagtgacgatctcataaaaatgttaaaggagagagattaaaatttagacaaatcctttcaagaaaactaaacgtttctcctatctatatggaaattcattttaatctgaataacttttaagtttaaagggtgctaaagtgcatcctttttttttttttttaaaaacactctttatgggtgttttagtttgtattagctataggatgtaatgcatgattatgatcatctagaagataatcaggatgcgcttttaacattgtatatttaattgttttatcaggattacccacgaagtattatgtcatcaaagggaaggctttttattatggtgatgcatattctcgatcacactggtttgcctatgcaactggttctctagcagaaatcgtctttgggtctaaaggggcaggtgccattacaaaaacgggaacaactgcagctaaaacaacggtgaagaaagggctggaacaaggagcaagatcgataacgtcaccattccaaatctattgccatattcaccaaagtttcaactagcaggtggagggaaactgccttataatgtgtttgatggtgagaatatcaaaaataagcttctctccatggcaaagcgactagacaattcagaaggtaatggaggtcatttgacctcatctaataaaggatataagggtatagacaatgctaatgatataaccaaattaactgtcgatgatataccaactgcaaaaagtgggaactttaataaatttttcaattcccttacaagtaaagaactagacgaactttggaaagataaaagaattagaaagaaaatagaacgtcagcttagagaacctggaggtttacatgagtggcacttagtttcaagagcgccgcaatttaagcattggaatattagtgctgaagagattaaagatttacgaacagcaatatctgatattaaattcgtcaatccaaacggtgtccatggtggattaggctcaactaaggcacataatgaattgttagcaataatagatacttctagcgactatgatacatttgtaagacgacttaataattgggctaattatagactagagggtggggtttcatctttaccggaaggtcttaaattaaagtaggaggatattaaaatgaaaaaaaaaggattggtttctatttggctaggtactattaaaaaaggggactctatagaagagtatgtagatttaaagtatgatgaggatggcgagtctgtaccttccaaattttttattgattttaatattgatatggatgaaacagatgaggatacaatagaaaaagcagtctataagaatagtagtagtgatatttcatcattattagatgggtgttcgtatgaagagattgtcatcccaaaaatccagaaaagtataaacctaaagaaatcatataacgcagtaattttaatatataattttgaatataacaatgaaattagttcaactggtgcttttgattttattgctactacaaattatgaataagagaacccttaaaggttctgattagcaagactacaggcaaagagattgatataatgtaatttatgtgaaaccttgattggcaaagtgcctttcaaggtttttttgttgaagagatacctagtgactaatgaactatttattacttacaaaatagagataatctttgcaatcccaatctgatgttttaacaaaatttttagtacgtacaacaccttttaattgtatgccctatttaatgaatttcttaaaaattgtcatatactaccatttttattcccgaatattttaccatccctttctccctgccttttaaatttttctcaacttttacgaacgatcactatggacggattgctaaaatcgaagcaagtgatttaaaatacggagaggtcaaaagaaaccaatatgcccaatccaattcaggaaagccggaccgattactagatgatgacggaggtcatttaattgcgtctatttttaaaggatcaggcgatattgataacctacttccaatgaattcacagattaatcgaagcggcgggaaatggtacaccatggagcaacggtggttgaaagctttgaattcaaacccacctaaacaagtagcagtgaacattgaacctatctataagggagattcattacgacctgttagtttctctgtggagtataaaattggagaacgttattctcaagtatttattaagaatcaacctggaggttaaaacccaatggaagaattagaaataaattataaaaaaatagcagaatcaattaatgaattaataccatgtgattgggataaagtttggatgtatgcagaaatacttgatgattcagcaggaattactttttactttactgaatctaatagtgaagagtatatttatggacacgatattcccgaacgatatagagtaagtaattctatttataatcatttactagtcgaacttagtgataaatttagagaattgaaaaaggaatatataaaatatgatttaggagtttggactacagcgactcttcagttagagtcatcaggaaaatttactattgagtatggatatgatgatgtttattcattaggcatagacaatgtgcaaagaatcgcagtttgggaatatgaaacgttcggatttttacccgacgatgaggaagataaagaagccgtattaaattatataaaaaataaagacgataactaacgcacaataccctccgatttaaagagggtatttgtcatatatgtttcaaaaaacctcatttcctttatttaaaccgataaaccgtcacttcacaatcacccagtacctcttcaatcatctcttcaacaatcatccaatcgccgccagccaatccgcagccgattccatatggaatggcgatggacgtttggtttttctcctcaggtgattgtgtcactgtatcctttaagtgttgaaagcagctgcgtaaggcatcgtagtctgtttgctgtcttgttcttccgtatccaacttgggcaaataagttggcaattgtttttccgtcttttgttggggtgagttgaacggagcttaacaagtcatctccttgttctgtacataattgtttataatctttgtacacattcggatatttgcttttgatctgtttcgctaatccagcgcccatgactcctttacagttcacctggtgacagatgatgtcttcgcttgcctctaaaatgttgccatccaccgttttgatcatatgatgtaacccctttttgataaaatgcaaacctatgttctattataacagttgtgatcatgatatttaagagccaaaatgcttttgatgggtttatttaaagacacttcaacatgatctgattgtcaaagttgatacatgtcatctagaatatggagagactgcaaacgcgaaatcaagcagaaacagtgaggggtacaatatgaatctattagaaacgaaccggttaatgattagaccgttttgcgatgaagatgccgcaggaatgctagagtacttggctcatccaagagtcaattgttttcttgatgatcgaatctctacattggaggaagcggctgctaaggtgcaaaagagaaaagaagattactcatatgtagcagtttgtttaaaagaaagtgggcaggttattggtgaattgtttcatttaaaagaagagcctgatacgtattcaattggatggaattttaatgcagcgtatgaaggaaagggatatgcacgagagagtgctgaggcattattgtcctatttatttgaagaaaaggcagcaaggcggctttatgcctatgtagaagatgataatgtccgttcacaggcattatgtgagcgactaggcatgcggagagaagggctgtttcttgagtttatttcatttactacatatgaggatggcacccctaaatatgaaaacacgtaccaatatgctttactaaaaaaggaatgggagcagcatcactctctatagagcagtaagtgaatgatcttcagtgacagcaaagtgacaaacatgtcatatgattccatggtttgttcgttcaatcgatggaggagtcatcttatttcatttatccttgtcataaatcgaggaaaaagggatgaaatgagatgcagggatataatgaagatttatttaggtgggtgaatcagctcagtatcgatcatggttatttgaatccgatattcattggactagctgaatatattgtgctgttagcagcactcacgtgtctgttcatatggtttcaaaatcgaagtagaaccaataggggcatggttgtatctgctggacttactttcatattggcagagttaatgggaaaaattgcaggtgttttttattccaaccagcagccctttgccgaaatgagtcatgtcaatcttttgatttcaaaggaagtgaataactcttttccgagtgatcataccatctttattttttctgtttgtctgatcttttggctttttcacaaacgccatgtttattggctgttcatagcatgcgccgttggtttttcaagaatttgggtaggtgtccattatccatttgatgtcttagcaggtgctgccatagcgagtttaacagcggtcactgttgtctatttgccgatatgccaaaggagcgtgaatgccattttggcatgttatgagtggcttgaacagaatgttgtaaggaagagaacaaaataacatgttgcagcaaaatgccccgatctgtttatggctcagatcggggtgctttttattttcgccaaaacgttgaacaatccgctttgtcttcgatattaaattcaatgattttctttaggagaggataatcaactggtaagctttccttcatgcgaaacatcttttttccatgatcgtaacccgcttgtacaatgtcagctgaaaagtgatcaattcctttaccttctggtgcgacagatatgtgatgttttgccacgctaaacccaataataaatgtgccatggtctgtgaacatcggctgattccaagcaattcttggctctagtcgagggaatgtgtctaaaatccattgtaaaatgtcttgcgtgcgctgctttagctctgggttaccaatgttgcttacatactcttcaaacacatgcatgatattttatcctcccattccatctacctcataagcctcagacgggattcgaacccgcactcctttcgtaagcataggctaggggcaacacgcttccctacggaatttcaccgacaggaatttcacctgtctcagctcgtgtgcttttcggtgcttctgaaacccttgccttgcgacccgccagctacaatttgttttacggcgctcttcccttctagagctactgaggcgcggaagttattgatcatattatataaagaaactggataaatgaaaagctgcgctgataattagtttactgatctttaggcgaatcgtacaaaatagtcataggcactatgataaaagaccatatggtttgtgtttgtatacagcattgaattgggctgatggaaagtgacaaacctgttgataagtaaactgaaagagatcaatattcacacaaaaaatgaaggttttactcacaaatgtccaataagttctcctttatttgctcatcatggaagatgcggaatctttctactcatgggtgttctttgatagaagtgtccaacaggaataaccgatcctgcacaattgtaaccactaactcaatgtacacctccagtgcttgttgtcttaggcgggacagcggtttctttgcctaataatcagagcttagatggttttacggcaagtggtggaaatacgatttttacagtgccagtatcgggttgctatttcatcgcatattaagtgaacacaaacgcagtgctgcttgctggaacaaggctgattaacagcggatctgccattgctggttttatattaacatccgttttacagcatttccctgcaacgtatcactcattacaacacttgcagcgggtaaccaaatttttggtatagtcgcaacagtggtgttacttggggagggtctgttggagcggcacttatcttcatccgattggaataaagacaaaaagccccaaaaagggctttttttatttcatcactagatgactcgttattttaaaatcgaaaaaaggcggaatttttacgcaaacttcattgactagaagaaagaaacgcattttcaaaggaaacggttattgaagattgaagtgattcatattaaaatgatctcaaatggactaattagcaattgctaatagaagttccatatttagtgaaatcatgtgttgcagctgaaggtgattgggggtgtagaatgagcaagattcctgttgcggaattggcatcattattaaatgactggaacatggaaattaaaaaggatcatgcagatgaggcagaacggctatttgctaaagcgaaacaagcagtagaggaaattgatgatgcggacatccttatgtactattctcttcttgagaagagacatcacattctcatgtacaatttaagaggtcaaaagggcagtgtttcaaccaaaagtatagaaggtcttcacgggaaaaaagaggaggacttatctaatcgacttgcctactattttgatttttatgagggggtgtatgagcagcatcaagggaattacgaggttgcattgcaaatgtatcaaagtgctgaaaagctcttagataaaattccaagtgagatcgaacgtgctgattttgattttaaggtggcctggctttactaccggcttagtcatatcatgctctcattaagctatatccgcagagctcttcacgtttataaacggcacaagcattatgaaagaagaaccgcactttcgtattctctcatagcggcgaatcaaactgagatcggccggtatgaagaggcgcttgaaaattaccgtctggcggaagaggttttgacaaaagagcaggatgattttatgctggctcagcttcatcacaatgtggccattttatattcattttggaataaaccgaaagaatcagtacatcatcttgaaaaagcattgtcccatcaagaatattacgagtcggatttctttttccattctacgtatctgatgagccgggaactctgtgtgattggtgaaaagcagcgtgcaagccaatatatagaggctgcgtatgcgcgaataaaagatgcttctcatgaagtgtttcagctgaaaataggcatcgtccatgacctttacttaacgaatgcaccacaaagatttcagcaaattgatgagaaattaagaaagttagaagagaagaatgaatatcatgaagtaaaagagctttcacattttgcggctaagtattgtgaaaagcaaacactttatgagcagtctgttttttacttcaataaaagtttagaagcggatttacatatgaaaagaatggggttgatttaagatgaaaacaggattaaaagtattattcgttgtgggtttagcggttgctgtggcagttttaactgaaaacgtagcgggttctttcgaagtagcagaaaaaattattggtggttaattcaccatttatctcttgcccttgttgatgatcgtcagcaagggttttttgtatgtgattaataggctcttcttattaaacgctacaagaacgtttaataagaagaattcgcaacaaagggggtgtgcaaatttgttacctgctccattattctaaataatcatagggcagagcaacaagttaaaaaggtcacctttctttgcttaatttaattttttgcaggacttttcattcaaattttatcaaattggtctattgtacatagaatttgttacaaaagagggaacaccgctccatttgtcacgcatatgatgagatgaggtgtaacttgaaggcaggtgattgtatgtatccacgggtatatggaggttttcatggaggcggttttagcggaggagcagtggggccacatattggctttggcgggtattatgtgagccctggcgtgttctctggcttaggaggttatcctggatatggtggattcgggacattttctggatattctccatatggctccacgttcattatggggcgtcctcctggtttttatgtaagaagttattagtgttttatcacagtgattgaaatagccttctagagaatggctatttcaattggtgaaagtgcttaattgcagcagttatcacaatgactccaaggatagagataggcagccaaatgatgataaacggatcgtatgcatctgtgtatgccgctaaagcagcacctaggcagtaaaaaacaatagagcctattcgcatgaaactgacatgctgaatgggagcttttcttttttcctgatgtgaaatgcgctgagccaaatcctcaaataggttagcgagtgtactcgttagaaccgttgtggaaataccagccacatctaatttgcgggcggccgctgtttgcaggcccatggccatacttaaaaggataatcagcataaaataagcaccttgtgtataagggaaaatggtcataagagcaaatagaagcagtatgaggacttctatgataaagatacgtgtaacggcttttggccaaaacgttttctcatgttttccgcctatcacaacagctagtaaaacccctaaaacaaatccactcagtgcagtgatggaatgaagggctgtaagctgcaaggagcttcctgctgcaatgccaagcagcacaatattacctgtcatattggctgtaaacacatgccctaagctcaaatagccaatcacatccacaatacctgctgcaaggcacaagaaaataagtgctatatttcgaaatgaatgtgcggtcaaaatggtcatccctttcttgctctctaatgaataagtgtaacgcttaatgaccgcgtatgtccatcttatgtgccgggataatgtcctcaagccggtgcaaaacttgtctgaaagtgtcatcatttacaaggtgtctcatgcggcggaatggatcgcctttttcctttagacgctctatcacagctggcatggtaaacaaagaagggtgaagtccatcttgatggagttcgtcccattcaagcggtgtcgctacaagcccaagctcatttcctcttggtgaatagggcgcaatgattgtttttccagcatcgtgctgaatatagtctaaatacaagcgattgccgcgttttttcttaagacgttccagagtaaatagctcaggtgcttgttcacataaaaattggcatataaacgcggtaaatgttctcgtttcttcgtatgtgaaggcatttttctttaatggaatataaacttgcagtcctttaccaccgcttgttttaataaaggctgtaagaaagagaccgtctaaaagcgttttgattcgcttagcagcttctatggctagatgaaactcgttaacagatggcgggtctaaatcaaagacgatttcgatcggccgattcgtatcccttgtttcaaaaggaatatgaaattccattgcaagctggttaccgagccaaagaagcgtctgagggtcattacagacagtgtatgaaatatcatcagcttgatcggtcaacacataatgtggggcataatcaggtgtcgatttttgataaaagaattcatcccctgcgccatgaggaaaccgaattaaagtcagccgtctttcacgtaaaaagggcaagagatagggagcggcttgtcttaaataaagtaagtaatctgccttgttcagatgaagagacggcacaatcggtttttcaggatgagtgacgtcaatcacagcagggagcggatacagctgtttgagcatttgctgaaacgtacacgccgctgggtcagtatctagtaaaaaggaagaaaaacgcggctctcttaaggcggacccatcaaaggagatacaagcaatgctcgcgacgatagaaggtgggatttcatatcctgatgttcctatttgtttgccttttgtttgaaaaagcgtacgcagcgtttgttcttcttctttagaaaatccatgcttgaattggacaacctcggtgagatgatgatcttgataaatacagccttggaagtagccattttctttatcaaaacgagtcacaatgacagagatatatcgccagtttttgactttcagccattcttttgaccgtgtattctcgtgccatttactcgtcccttttttcgcaacgagtccttctgctaaatacgtcgtcatcagctttttcatatgttcaggatttgtgtctgtatgaatgagttgaagaagggaagggtgctcaagctgaacagatggcggaagttttgctgctttgaaaacttgctgtacctgttttttcctttccatcaacggcaaatcaattagagattgccctttgcatcttaatagatcaaatacgatcaaatgacatggaaaccgctcagcctgttgcttaatcgcctctttgttttttaatctgcctctttgctgaaccgtcgcaaaatcgctttgctgttcatccagtaaaaagaccaattctccatcaaacgtcagaggtaaaaaaagagcaaactgatcccttaattgttcgcactgttcaatcacctcaggaaactgttcgtttaatcgttttccggctctgctttctaaatgaatcttgttttgctcccacgtcagaatgactcgaaagccgtcatattttaattcatacacccagtctgcaccggtaggaacatcatgtgcagccgttaatcgcataggtttcatttgtgcatgtcacttcctcatatgatgtgttcttagagtgggatgaaattttcattcacatacataagtctaacgaaaacattgcatagtaaagagaaaagaacggaggcgacgcgatgcatacagtttggaaaggcggcattagctttggactagtcaatattccagtgaagctgtttactgctacagagaacaaagatattaagttaagacagctgcataaagagtgtcacacccccattaactataaaaaggtttgtgccaactgcggggaagaggtggcaccagaacaaattgtaaaagcgtacgagtatgcaaaaaataaattcattgagttagacgaggaagagcttgaaaaactgcgaaaagaaaatgaagaaaaagccgttgaaattattgattttgtgaagatagaagagattgatccaatctattatgaaagaagttactttttatcaccagataccggcggagcgaaggcttactcattattaagaaaagctttagaggaatcggggaaaattggtgtggcaaagattatgatccgctcaaaggaacaattagcgatcgttaggtgctatgaacatattttactgatggaaaccattcattttcctgatgaaattagacaggtatcagatgtaccaaatatcccgcaagaggaaaacattgtgaaaaaagagttagatacagcgcttcttttaatcgaacaattaaccacaacttttgatccagctgcctatcaggatgaatacagagaacagctgatgaatttaatcggagataaaatatctggagaacataccgttcagccagaaacgacaggcaaaaaagatcctgcatccaatgtaactgatttaatggcagcgctacaggcttcaattgaccgatcgaaaccagccaaagcgaaaaaagcagcacctaaaaaaagaaaagcaccagcgaaaaaagaaaagaatgcataaaaatagaccgctcctaggcggtcttattgcggttttaacacgtcctgaatgttcccatcatttctatggataacaactgaagtccctttattagaggcaatctccttagcccggttaattgcttcttgtttcgtttgtttgacctcacttgctcgttttgctttctctgtttgaaccgcccagccatcttcatgtttgacgacatgctgggcatgatccataagctctggtcttgcggagctgctgtctttagatggcgtgacagaaccatgggctgagaaattctcgatctctttttccgttgcgttctttttccattctttcgcttgactgatcgcaattgggatggctctactttcgtcatagccttcctgtatcattttgttcgcaacctcaagcgctttttttcgaataatgtgatctaacgaatgaaatgaagccggataatcattcattgtccaaggcatataaaacgctcctttcttttatttgaacaccttcccccatctgcaatggatcaaacatatcattcttctcaaactaatgaaggggataaaatacatcgttttgctgaagtgtcatttcattaaatcccgcagaatagaaagtagaaaaggagtggttttgatgatgataaaaggtttgtatgaagctcatttacctgtgaatgatttgaaggcgtctattgcgttttatgaaaaattggaattgacacttgctcaccaaaatgaaagagttgcttttttatggattgagaaaggaaagagctggcttggtttgtggaaagtagatatcaatgacttcccataccatccctcgactcggcacgttgcctttcaaattacaacgtccagtattgaacagatcaaggcttggctggttgaaaagggcatcggcattcacccaatgtttggcttttcagaagagaggcagcctttagttctggataatccaccgcaatttcatgcagcgatctattttcttgacccagatggaaatctgcttgaatgcattgcgccgcttgagcttgatacagaagaagactacgatagcatgacttatgaggactggcatcgaaagaaaaatccatttatagattgacaaaaaccactcattgtaactatattgattacaacggtggtgaaagattgtgaagcaaattagcagcaggtatccgattgctgttcatattgtgtcatttattgcaggtgttccaaaagagtgtacaggtgattttattgcagagagcgtgaattcaaatccagccattgttcgaaaaatgatggcaatgctcaaacgggcggatcttattgagatccgccgcggagtaggcggtgcttatttaaaaagaccggctgaggaaatcacgctattagatgtgtaccgcgctgtcgatgtaagcgaggatgaagaattatttaactttcatcagcccgtcatcgcatgcccgattggtcaagcgatggatacgagattgcggcatgaactaaaagaagcacaagctgcacttgagaatcatctaaagcaagtgacaattcagcaattattgacagaggcggaataaaaaagctcatacattggagctttttttacacctttgttgtaaccattttgattataacgtatgcacatcaccgttgaacgaaaaatgaggaggtcaaacaaatgaaattattagtaacaggcgcaacaggacagcttggatcgctcgtcgtccagcatttacttaaaaaggtaccagctgaacaaattgcggtgagtgttcgagatccgcaaaaggcagcacatttgaaggaagctggggtggatgtacgcctcggagactttactcagccagacactcttaaggcagcctttcaaggcattgaccgccttttgatcatttcaactgcggatggagaccgcgtgcagcagcatacggctgccatccaagcggcgaaagcagctagtgtatccttgattgcttatacaagcgttgtgaatgcaagagagagtcagcttgtccttgcacacgaccatgcaaaaactgaagaagccattgtcgcttctggtattcctcatgtgtttctaagaaacaactggtatgtagaaaatgaaaaagatacgatactagcagccgttagcggcgcaccatttttaagtccaattggtgatggcaaggttggctgggcaacaagaaatgactacgcagaagcggccgcaaatgcgttaacactttctgaacatagcaaagagaaatatgaactgtcaggacctcttcggacgcatactgaacttgcgcgcattgtcagtgaagtgagcggaaaagagatcaatgtggagcaaattactgtcgacacatttggagaatttttagcttctaatggggtaccaaaagaagctgtgccatttgtcaaagccattcaaagcgggattcgcgatggtgccttagccattgaaagccatgatttcgaaaccttattaggccggccgttaacgcctatcgacgaaaaaattcgtgaaatgatttcaaaataaacatcaaaaacgcccaattaaaagggcgtttttttgtccaaatttagacaaatcacttcgttgaaatttcagaaatttgggattaaaatgaaaatatagcctgttatttcgtcatcagatgaccaaattgatgaatcaaattgcagcaaagaagggaagttcgccgatgaaagtccatttattcgttacttgtttaattgacaccatgcagccaaatgtaggaaaggccacagtggaagtattagaaaggctcggtgtagaagtggaatttccagaggcacaagtgtgctgcgggcagccagcctttaacagcggctattcaaaagaaaccattaaagcagcaaaaaacatgatcaaagcctttgaatcagctgaatatgtcgtgacgccgtcaggctcttgtaaggcgatgtttttagaatatcctcaacttttaaaagaagatccagtgtggtcagcaaaagctgaagcacttgctgagaaaacatatgaattaaccgagtttattgttgatatattacacgtcacagatgtaggcgcgagcctgaaaggaaacgcagcctatcacacttcctgtcatatgacgagactgctgcgaattaaggaagcccctttcactctattgtcaaatgtcaaagatttgacgatgacaccattgccacgcgcagaaaattgctgcggatttggaggaaccttttcagtaaaaatgacacctatatctgagcaaatggtcgatgaaaaagtccaaagcatagaggagacaggcgctgaatatatcattggtgctgactgcggctgcttgctcaatattggcgggagactgaatcgtcttgataaatccattcaagtgatgcatatcgcagaggtattaaatagccgctgactttaagagggggaacggcacatgagtatgaaaattggagcgaaggcctttaaagaacgaatcggggaaggattagaagatacggtcatgagaggagctgtttcctcagcgcaggaacgcctgtatgaaaggcggctatctgcgagcgaagaacttggcaactgggaaaagtggcgagaacttggtgaggaaatccgtcagcatacgctgacgcatcttgatgactacttataccagttaagtgaaagcgttagtgcacgcggaggacatgtcttttttgcaaaaacaaaggaagaggcatcggcgtatattcaacatgtggcacagaaaaaagcggccaaaaagatcgttaaatcaaaatcaatggtcacagaagaaattgaaatgaatcaagcccttgaagagatcggctgtgacgtggtggaaagtgaccttggcgagtatattctgcaagtagatgatcatgaacctccttcacatattgtggcacctgctcttcatatgacgaaagaacaaataagagaagtctttcacgaaaagctcgggtatgagatgtcagagacacctgaagatatgacgagttttgtgagagccatattacgtgaaaagttcctcgaagcagatattggtgtcaccggctgtaattttgctgtcgccaatacaggctccatttgccttgtgacaaatgaagggaatgcggatcttgttacggctatcccgaagacacatatcgccgttatgggcatggaacggattgttccaacgatggaggagctggatgtcctcgttggtcttttgtgcagaagtgcagtcggtcagaaattaacgagttatatttctgtcgtcggaccaaaaggagaagaagaagtggatggaccagaagaatttcacctggttattgtggacaatgggcggtccaatatattaggtactccctttcagcctgttctccaatgtatccggtgcgcagcctgcatcaatgtgtgcccagtttaccggcatgtgggcggacattcatacggatcgatttatccggggccaattggcgctgttttatcgccgcttcttggcggctatgatgactaccaagagctcccctttgcatccagcctttgcgcggcctgcacagatgcttgtccagtaaagatcccgcttcacgaattattaataaaacatcgacaagtcattgttgaaaaagaggggagagcgcctaaagctgaaatgatggcgatgaaaatgttcggaatgggtgcatcgactcccggtatgtatcattttggaacaaaagcagctcctgtattgatgaatcgtatggcttcaaacggacagatttcaaaaggaataggtcctttaaagaattggacagatattcgtgacctgccagctccaagtaaagaaagattcagggattggtttaaaaagagacagaaggaggagcagtgatgaagggaaccatttttcaccgagaatcgttcttagcgcatattcgtcagcaattagggaaggattcctcctcgtctgcatctattcagcgtccggcttggaagcatcaagttcagtgggaaacaaacggacttttgtctaaagaagagctagttgagcaactgaaggtgcaatgtcaacgaattcacacaagagtggtcgaaacaaaacctgaggaagcgccctctgtattacgatcattgatgacagagtatggagagggttctgtgatgacatcgggcgatcatcgttttgaacaatatggattttatccgatgtttgacagcttgcagcacgaagggttcgcagtcaccagctggaatgctgaagcatcaagggaagaaaatatcaggctggcagaacaagcggcttattcggttgtatttagtgattatactcttgcagaatcagggacagtcgtcctttcatcccatcagggccaaggaagagcgctgcattttttaccgatgatgtatatcgtgtgtgtcgaaaaaagcacggtggttccgcggatgattcaggcagtttcggctcttaatcgctcggtagaggagggggaagaggcgaaaggtgcgattcatttcatatcaggtccgagtaactctgcggatattgagatgaatttagtagtaggtgttcatggtccagttcgggcggtttatctattgatagatgatgaatagggctttcgagatgaaagccttttttcatacaaaaaaagcttacatcagttttaaaatcatcttgcctctagcggattggacatagtaagatgacgacatacaaggatgaacttctcatctactgctgatgtaaaggaagctgctcatggacatgaagtcaactgctcaaaagaaatcaattgcactaccgcttgtgatttcaattattgccatttcgttttctgctattattgtgaaatggtcaaatgcacctgctgctattttaagtatgtatcgaatgatctttgccgcggtttttatgctgccgtttattctgccacgaaaaaaagaatttctctcgattcagagaagagactggtttttcttatgtatgtcaggcttctttttaggactccattttgtgttgtggtttggctcactgaagctgacgactgtggcaagctctactattatcatcgcccttcagccgatggtctccttattaggcggctttctcatttttcgtgaacgaaccacgctccctgcacttttgacgatgtgtgccgcaattgttggtgcacttatgattgggtggggagacataggtcatagccaggaagccatcctaggagacattttatcctttttaagtgtgatcgccgttgtttgttatttattaataggtcaacaggctgtcagaaagatatctcattggatttatagtttttgtgtgtttggttttgccggtctttttttaattttatttaatttgatgcagcaaactccttttacaggctatccaggtaaagagtggggaatctttttattgcttgcgatcattcccaccatgtctcatgtcattaataattggcttttaacctatgtcaatgccacaaccatttcaatgagtatccttggcgaacctgttggagccacgattcttgctgtatggctgcttggagaaaaagtcacgctgcttcaaatgtgtggcggttttcttgtccttttaggcgtctttttctttttgatgcagcagcggcaagggattgtgatgaaacaaaaaaaatccggttaaatcccggatttttactcttttaaatcgttcttttcaatcactttgtttaatctttcctcgaccttcttcaattccattcgttttcttctgatcattcgaaaagcgatgacaatgatcgtcacgatagcagcaatgaatagaagagagaacacttgaaatagaagatcacccatgttaaatgccatattctctccgttagacatacgtaaaacctccctttctatctatatattaccataattaataaaagattgagatttatccattatttatctataataggtaaaatatcacttgttaaaggagaaccaatatgagaactttagtccttttacgaggtctcccaggcgcagggaaatcaacttggatcaaagcccaaggcttagagccttacacgttatcagcggatcagatccgtcttttgacccggcctccgcagttatctgtcaatgggaaaccagaaatttcaagcaaacatgaccacaaagtctggtctttattatttgaattgcttacagctcgtatggaacgtggagattttactgtaattgatgccacgcatatttcaagcaaatcgatatctcaatataaatcgctggccacatcgtatcgttacagggtgtatgtcgtcgatttcacgcaggtgccgcttgaaacagctctcctgcaaaatcgctcacgggaagctcacaaagttgttcgggagtctgttttatatcaaatgaacgagcgtttaaaaatagaaaaggtcccatcatgggtgacggtcttgcagccggaggaatattcgcaagtgatgacctatcagcctcgatcctttgatcaatatgaggccattcatatctttggagatattcacggctgtcatactgctctgaccacctatttgcaaggagatattaaagaaaatgaactttatatatttgcaggtgatttacttgatagagggatagaaaacaaggaagtattagaatggatgctcgcacatagagaatgccggaatgtcatcgtaattgagggcaatcatgatcagcatttataccggtttgcacatgatgaaaaagtaagaagcaatatgtttaaccggcatactgcacctgaaatcgaagcagcagactttgatttaaaagaagtacggaagtttgtcagaacatttcatcagctcacttattttacgtaccatggcaagacatttcttgttacccacggggggcttgctcatttgccagaagagcttctgcatgtctcaacacagcagctcattcacggtgtaggtgaatattcagatgacattgaccatttgtttgttcaaaacactgctggattagatgtcattcaaattcacgggcatcgcaatttatacaggctgcctactcaagcagcggaaaggtcttataatctagaaggccaggttgaattcgggggacagctgagggtgttgaaaatcacagctgacgggattgagacacatgaaattgacaacccagtctatagagcttctgaaaaaaaaccatcggctgctattcaaccagatatctcactagatgactttttagctcacttagatcagcatgaatatgtacaggaattaaagcttccgcaccatatttcatcttttaattttacgaaaaaagcgtttagtgaacggcagtgggatgatgtgaatgtgaaggcaagaggtttgtttgtcaatatggtgtcaaagcagattgtttcaagaagctacaacaaattttttaacattgatgagcgtccggagacaaaaatgcatcatctagtgaaccaccttcaatttcctgttaccgtctatgataaagcaaatggatatttagggacggttgggtataacgaaatggaagatgaattggtgtttacgtccaaatcgtatacatctcatgtgaagcaaaaccagcatgcttcttgggtcgaagagttattctatcagaccttcggagacgtgcaggtcgactacatcaaatcatacgtacgtgaccacaatgtatctcttgtgtttgaagtcattttgccagagaaagacccgcatataatcacatatgatcatgatcaactcattttacttgatattgtgaagcgtcagctgagctatgaaaaggcaccttttactgaagtgaaaagagtaagcgaacagcttggaatgtcctgtaagcaggaagtggctgtgttccatgattggacctctttttataaatggtatcaggccgtctctcatgacgacacgatcaaagaagagggatatgtcattgaggatgatcgcggctttatgaccaagctcaagcttccttattatcaattttggaagcagatgcgttcgatcaaacagcgcgttgcagagaagcgttccacgcaaaaatatatgcaggcattgcaaacagcggagcaagctagattttatacgtggcttcttgagcaagatgccaatgctgtcagaaatagctccattattgagctgcgttcacaatttgagcaaagcgatgctgtccaattgaataatgatggaataaatgcatagtctaaaaagaagtcttttctaaggaaaaggcttttttgatgcaattgaaaggtggacccttacatgccagaccatattgaagtcattttacggacgatgtttgcttttgcgattttatttgtcggagcacgtcttcttggaaaacaaaccattgcgcaaatgaatatttttgattttatagcagccatcagcttaggttcaattgcggcgagtctcgcgtttaatactacgctgccgtttcatcacacgacgatttcctttgtcacgcttgtcatgatcatttatgtgatttctctcattgctttaaggagccgaaaattgagaggatttatggccggtaaaccaacccttgtcatacaaaatggcaaaattcttgaagagaatatgaagggaatgaggtatacccttgattatttaaatcagcagctgagagaaaaagacatttttgatattagcgaagttgaatttgccatgattgaaacagatgggcatatgtcagtgaaaaaatatccttcgtttgaaaatgtcactcgaaaggatattcaattgtatatgaaggcagagggctacatgcctatcgaagtgatcatggacggaaagctcattttgaaaaacattcatgaaaatcaattaactgtggagtggatagaggaagagcttaagaaaaggcagctctccttaaaggacattgtatacgcagtccgttcaagtaatggcagcttatatattgatacatatgacgaccacattcactctccgattgatcaagaatgaaggtatagtgcggaggtcaccctcctgacacatatctgtcagtgtttctaagtcgtttggatgctgtctgactaggcatcatttctcaattattattattttcagaaaatgtggtgacggagaaaaataagtatgtttaagtataaatagaagaaattaaaatattaatataatatatatcaagcggaatgaacattcattcctagtgaaacgaaaggagaggatgaaatgtctgtagcgactagtgataaacaggagcagattatgaaggcttcactggacttatttattgaacgtggctttgatggcacaacgatgccgatgatttcaaaaaaagccaacgttggagcgggaaccatttatcggtatttcgatagtaaagaagcactcgtcaacattttataccagcgaagcctcactgcgtttatcgacaaaatcagcacaaacagtccagacccaaaagcaagtatcagagcctattttaagcatgtcttttattgcttggttttgtttacaaaggagaacccgagtggtctgtacttcttagaaattgataaacggtcacattatttagatgagataagtaaagagaaaatgcagcaattgttaaatgagctatttctcatctttgaagaagggaagaaggatgggattcatccgaatctatcagggagaaccattttatccattgtatttggcgcattcgtccagcttcacaagcaaattcttgcagaagaaatagagccaacgattgaatttttagaggaaattgagcaatgtttatggcgcgccattagcgttgcatcataaagaaataaagggagtgggcatatgaagcaaacatcaatcattccaaaaccaaaaacatacggaccttttaaaaatattccccatataaaaaagggagagctttctcaaaccttttggcggctagcagatgaattaggaccaatttttcagtttgaattttcaaatgcaacaagtatttttgtttccagccatgaacttgtcaaagaagtatgtgacgaaagccgttttgataaatttattggaactagtctcaataaagtaagagcatttgcaggagatggactatttacaagctggacagaagaaccgaactggagaaaggctcatcaaattttgatgcctgcatttagccagcaggccatgaagggctatcatgagatgatgctcgatattgccacacagcttgtgcaaaaatggcaaagaacaggccgcgatgaagaaattgaagtagctgaggatatgacaaagctgactttagatacgatcggtctttgcggttttgattttcgctttaacagcttttataaagaaaatcagcatccgttcatcgaaagcatgctgaaaggcttaaatgaagcaatggagcagtcgagccgattgccgattgcagataaactcatgatcaaaagaagaaaagaatttgaccagcatgtcgattttatgtcgaaattagtagatgacattattcaggaacgaaaaaaacaagataaaacgggcgatgatttactgtcacttatgctgcatgcagaggaccctgaaacaggtgaacgtttatccgatgaaaatatccgttatcaaatcattaccttcttaattgcagggcatgaaacaacaagcggactgctatcatttgcgatttatttcttactaaagaatccagagaaattaaagaaagccgtccaggaagcagatgaggtggtgcaaggcgggcttccgacatttaaacaggtgcaaaagctaagctacactcgtatggtgttaaatgaagcccttcgcctctggccaacagcgcctacgttctctctttatgcgaaagaggacacagtaatcggggagaaatatccgattcaaaagaatcaaagtgtctctgttctgctccctaaattacaccgtgatccagcagtatggggagaggattcagaagactttaaaccagagcggtttatgcaccctgagaaaatcccgcagcatgcctacaagccttttgggaatggacagcgtgcatgtatcggtatgcagttcgccctgcatgaagctacgatggttctcgcgatggtcctgcacaatttagagttaattgatcacacatcttatgagcttgatttaaaagagtctctcacaattaaacctaacgattttaaaatcaaagtgcggccaaggaagcagcaattctttatggctccaccgaaagaagaaccgaagaaaagaaccaaatctagtgagtcaaaagtggcgagtcacggtactccgctgctagttttgtacggatcaaatctcggcacagcaaagcaaatagcgaacgaattggttgaagacgggaaagcaaaagggttcgatgtgaccactgcgccgcttgatgactttacacgccgattgccagatacaggtgctgtcctcatcgtgaccgcttcatacaacggacatccacctgacaatgcgaagcaattcgtggattggttgacgcaggatgaagagcaggatctatcaaacgtgacatttgcagtctttgggtgtggagatcgaaattgggcgagtacgtatcagcgtattcctcgtctaattgatgaagcatttgagaaaaaaggggcaaaacgtttaacggatattggtgaaggcgatgcaggcggtgatatggatgaagataaagaaacattccataagacggtcttcgacgagcttgcaaaagaattcaatttaaccttgcaggagaaaagtcaggaaaagccgagcctatccattgcttatacgaatgagctagtggaacgtcctgtggctaaaacgtatggtgccttttcagctgttgtattgaaaaatcgagaactgcaaaccgaaaaaagtgcccgccaaacaaggcatatcgaacttcaattacctgaaggcaaacaatataaagaaggagaccatatcgggatcgtgccgaaaaatagcgcagcactcgttcagcgggtgaccgaccgttttaagctagatcctgagaagcacatcaggctctcttcggaaaaggaaacaagtcatttgccattaaatcagccgattcaagttgaagaattgctggcgtcacatgtagaacttcaagagcctgcgacacgtactcagttaagagagcttgcaaaatatacagtatgcccgcctcatcgtattgagcttgagcaaatggcgggagaaggttatcaagaagctgtattaaagaagcgtgtgaccatgctggatttactagaacaatatgaagcatgtgaactgccttttgatcatttcttagcccttttaccaggcttgaagcctcgttattattcgatctccagctcgccaaaggtagatgaaaagcggcttagtatcacagtagctgttgtaaaaggcaaagcatggaacggacgcggagaatatgccggagtcgcatcaacctatttatgtggtctgaaagaaggtgaagaagtcgcctgcttcctccacgaagcgcaggcaggattccagctaccaccttcatctgaattaccgatgatcatgatcggaccaggtacaggaatcgctccatttagagggtttgttcaggcaagagaagtgtggcagaaggaaggcaaaccactaggcgaagctcacctgtattttggctgccgtcaccctcatgaagatgatctgtattttgaggaaatgcagcttgcagcgcaaaaaggtgttgttcacatccatcgtgcttattctcgttacgatgagcaaaaaatatatgtccagcatttgttgaaagaagacgacggcacgctgatcaagttacttgatcaaggtgcgtatctttacgtgtgcggggacggaaaagtcatggcaccagacgtagaggctacattgatcgacctctatcaacacgggaaacaatgttcgaaggaagtagctgaaaattggctgacaacccttgcaaataataatagatatgtaaaagatgtatggagctgacaaaaggaaaaaccgccaattaggcggttttttctgtttcatcaagagaggtgagatcggtagaatgaaagtttgaaagttacaaaacacctaatttagaaatgaaatattttgtaaaaaataagaatattctctcatttactccaatatgaaacaatcgtatcatttttgatataggacataaaggaggaatatgatgaaaaaggtgaaaatgttactcccttctctacttgtttttggtgctttaagtgtgcctagttttgcccatgccgcatctgattcagtgctaacgtctgattatgacatggtgacttctgatggaaaagtgatctcttcaagtgatttccacaatgatacgaaatccccctcatcctttgataaagtggatgatctatcttcaactgttggtgaaaaagtaaaaccactatcaaaatatttaaaagactttcaaacaaaagtcgtcattggagacgatggtagaacaaaagtagcaaatacaagagtggcaccatataattcaattgcttatattacgtttggcggctccagctgcacggggaccctgattgcccctaacaaaattttgacaaacggacactgcgtgtacaatacagcatccagaagttatagtgcaaaaggatcggtgtatccaggcatgaacgatagtactgcggtgaatggctcagcaaatatgacagagttctatgtaccaagcgggtatatcaatacaggtgcgagccaatatgattttgccgtgatcaaaacagatacggacattggcaatacagtcggttaccgttccatccgtcaggtgacaaacttaactgggacaacgattataatttctggatatccaggtgataaaatgagatcaactggcaagatctcgcagtgggagatgtcaggtcctgtgacaagagaagatacgaatctcgcatactatatgattgatacatttagcggaaattcaggctcagcgatgctagatcaaaatcagcaaattgttggggttcataacgcagggtattcaaacggtacgattaatggcggtccaaaagcgacagctgcctttgttgaatttatcaactatgcaaaagcgcaataaaagctaaatcataaagcttgtttccttcataggggacaagcttttttatgtggatacaagtgtctatctgtttatgcttgaaaaatccattgacacttagcctcttcatttttttcacatgtcaatcgtgaacgactcatacattaaaatgacacattccctttaagtcaagattctgcttgagaaaaatgaggaggtctcacgcttttgaagatgagaagaggctggattactgctgtcgccttatgttttgtgatatggatgggcacgctgttaggtggatttggagaggaacatgcggcaaaaggtgcggatcgatatgatcatgttattcaatttccaaaggaacggtaccctgaaacaggcagtcatattcaagaagctattcgaaaagggcattcagatgtgtgtacgatagaccgaaatggagcagatgcccgcaggcaagaatcattaaaaggcattccgactaagcctggattcgaccgagatgagtggccgatggcagtttgtcttgaaggaggaaaaggggcgagtgttcaatatgtcagcccgtctgataataggggagcaggctcatgggtcggacaccagataagtgggtatcctgatgggaaaagaattttatttattgtgaaataaaactaaaagagaggcgcctgtgagtaggtgtctttttttgttcgatcagagcgtattggagttagcagggacaaaagattcagtgtacaattgatctataagatacaaagatagacaagaagaaaatgggaagggacatatgcttatggataagaaccgtgcattatacgattatttcatacaacatgcagagaaactgactgaaacttggtacgattcaattgaggatgatgatccagaatcaatttatcgttcaacagattccagcatcatatcagagctgaaacggcaaaatcaagattattaccagcattttatacgtgctcttattgaagacaagacatatttacatactgagtttaaaaagtggtctgaagatttagccagtgacccgaagcatttaaacacaccattagattatgttgtgagagaatacatgtccaatcaaagagtggtccttcattacttaaaagaatttattaagcagcgtcaagatgaaattgatattgaccgcatcttttattggtatgatttaatttcagaggcgtttaatatttccattcatgtgttcatccagcaatatgtaaaaaatacaacgaggaagctcgtggcacaaagagacatgatttacgagctgagctcacctgtcattgtcttaaaaagtcatattgcgttattgccgttagtaggtgatattgatacagcgagagcgaagattattttagaaaatacgctgaaacagtgctcacaaaaaggagtacagcatttatgtattgatttatcgggcgttgtcattattgatacaatggtggctcagcagatctttgatcttgtcacatcacttcggttaattggagtagagacaaccatttcaggaatcagaccagaaattgcccaaacggctgtacagctcgggcttccttttaatgaatttcgcaccgcagcatcacttgctcacgccctagaccgcatgactgaatttacttcaatataaaaaccaggccattcaatcggcctggttttttatttagataacagcgtcaatttttgtgactttccaatctttttgtcctttttcgaacgtaaccgttctttttactttgcgtccatcaagtgttgggacagtgaattcatatgtgcggactgtttgttttttagagacaagtttaggtgtggctttatcccaattaagcatattgtcaccgtcgccgactggaacagccattttgcctttatgaacaatgaactgatagtcttttaaaccttgattaatggcttcttttgtgaaaacttgagataggtagctgtttagttttttctttgtatcaaatgttttagaaagatagttgtaagtcatgtctttatagctaaatgattttaatttgtaatcagaatgttcattaattttgtagcctgacatcgcactccaaaagtgttcccgtgcatcaagggcaatatgtaacgcttctttatttgtcaaagtggctggttttttagaagcggccaatgttgtagattgtaatgagatcataagcataatagcagttaataaaacgaataattttttcaaggcgattgcctccttttctcaatgaaaacttcttatgttacaaatgttacaataattacagtgatattacaagtattaaattgaaatgttttttatttcttttctttctatatatataacgtttgagggtggcaaaaagttttcatttttttattttttctttatatctactatttaaccgttctaaagaagaacaaaacgttttttggaaaaatttctgtttggatgttcaacacgctttgtcattgatgacatatactatcgtgatgaatgtctaggaaagtggtgttgaatatgtattatccgtatgaaggtgtgtggaatgggtactcatatgacaggcagatgcaaggttggccgtcgttcccttctcaagttggaggatttccagggtttccaatcggaggaggaggcactgggcccggatctagtggatcagccccgccagctccaccacagcatatcatttcgcaatatcagcaagcgttatcgcagcctcaaagcatgcagtcacttatttcagggcagacaggtggaggacagcaatcggttcagtttgctgcgggatgtaatagaagatggacgattgtgtttatgagaaacggtcaagtgtttttaatgtatgttctatcttcacagcctttcgggagaacaactggctttatatggccgaactttacatttggttccttcccaagctcgagtattcttgcctattcttgttcataaaaaaaaagccggttctcatcattagctgatgaaataccggctttttttagtggatatttctaaatacgccaatcactttacctagtatacttacattctgtaaaataatcggttccatagatgggttttctggctgtaatctaaagtgtgtatcttctttatagaaacgcttcactgtcgcttcatcttcctctgtcatggcgacgacaatatctccattgttagcagtgctttgctgacgcacaatgacatagtccttgtccaaaattcctgcgtcaatcatactttctcccataatttcaagcataaatacttgttcatctggtgctgcaaaagtctctggaagagggaagtattcttctacattctcaacagccgtaataggcaggcctgctgttacttttccgatgactggtacgttcagtacagcactctttgggatattcatttcctcttcatctaatacttcgatcgctctaggttttgtcgggtctcttctaattaagcccttcgtttctagtctagctaaatgtccatgaaccgttgaacttgatgctagaccgacagcttctccaatttcacgaacagatgggggatagcccttactttttacttcttctttgatgaatgtcaggatatcgagttgtctttttgatagcttcgtcatcttttgcacctcaaaacgtcaattttaaagaaattatagcatgtttttcctaacagtacaaacataggttcgaaaaaaacgtttgacagaaacgtttgttcgtatttataataagtgacagaaagaacgaacacacattctattaggagagatgacattatgaggttaaaagaatctattatttttattggggtattctcattcatcgttggcatatttctctcacttattgcagtcacaagccataatgatccaaatcaatatgttaaaatagaagttcaatcaggtgatactctttgggggttagctgatcaagtaaacgacagcaaatcaatcgataaaaatgcgtttattgactgggttacccagcacaatgatcttgcttcaacagaaatccagcctggtgacatccttgttataccagtcaaaaaagagcatccagtcgtatatcaacttgcaacagtacagtagaaaggtcgattgaagacatgaatgcaatcatttatgcgagagtaagcactgttaaagaagagcaggaaacctcgctgaagagacaagaagaagaattgctggctttagctgctatgcacaagatgaatgtggttaaagtcattaaagaaaaagcaagcgggtatgatctagatcgtgatggtgtgtttgatatgctagctacactaaaagaagagtcaattgatgctgttcttatccaggatgaaacacgtctcggaagaggacaagcaaaaattgcgcttctccattgtctttttaaagagaatgtgaaggtgtacagtacgtttcatagaggcgagcttgagctttcagaagcagatgaaatggtgattgagatcgtaggagtcgttgaagaatatcaacgaaaaattcataacctgaaaatcaagcggggaatgagaagagctgtagaacgcgggtaccagcccgaactgaatttaaaacagcaggatcatgcgcctggtcgtgagcgtattgaagtgccaatttcagaaattgttcgattaagaaaaaacaacatgaccttcgccgaaattgcagcaactcttcaggcactaggttttgacatttcaaaagcaacggtccatagaaggtatcaagaatatgaaaaaggtctgaccacctaaagctcgatttgttgtcaaaatgattgatatttagtagtatgtagagaaaatgttttaaaggagttagtcatgatttctaaaaatcagcttgcaagaatcaatgagctttcaaaaaagtcaaaagagaccggtttgtcagacgctgaaaaaacagaacaaaagcaattaagagaagagtatttaaaagcttttcgttcttctatgaaaaatacacttaaaaccgtgaaaatcgttgatcctgaaggaaacgatgtcacaccagaaaaattaaaaagagaaagagatcaaaaccttcattaatagttgtatgatttcttgaattttgaaaagatgggaagaatattctcatcttttttcatatttgcataactttttaggtgatcgataaactaaatgtgacaaaatccttctttttcagcgtgaaatagttgtgaaaaaaggacagtagatttatgataatggtgtacacaagatacggaaggggatttatatggaaacgattgaattgaaatctattgcaacaatacgtactctctccatagacgcaattgaaaaagcgaattccggtcaccctggaatgccgatgggtgctgcaccaatggcatacgctttatggacgaatcacttaaacgtaagtccgcaaaacccaagttggtttaacagagaccgttttgtattatctgcgggacatggttctatgcttctatatagcatgcttcatttaagcggatacaacctgagcatcgatgatctaaaacaattccgccaatggggtagcaaaacacctggacatcctgaatttggacatacagagggcgtagatgccacaacaggtcctttagggcaggggattgccatggcagttggtatggcacttgcagaaagacaccttgcggaaacgtataacaaagacaactttaatgttgtagatcactatacatacagcatttgcggagatggagacttaatggagggaatttcctctgaagctgcttcacttgctggtcatttaggcttaggccgtttaattgttctttatgattcaaatgatatttctttagatggcgacctagatcgttcattctctgaaaatgtgaagaatcgttttgaagcgatgaactgggaagttctttatgtgaaagacggcaacaacattgaagaagtgacggctgctattgaaaaggcaaaacaaagcacagacagaccgacactgattgaagtgaaaacaacaattggttttggatcgccaaaccgtgcaggaacatctggtgtgcatggtgcaccacttggcagcgatgaagccaagctgacgaaggaagcttactcttggacgtttgaagaagatttccatgtaccttctgaagtgtacgatcatttcaaagaagctgtaaaagacgcaggtcagaagaaagaagcagcttggaatgaactatttgcgcaatatgaaaaagaataccctgagcttgcagctcaattgaagcttgcgattgaaggaaagcttcctgagaattgggatcaagaggttcctgtttatgaagcaggttcaagtcttgcctcccgcgcttcttcaggcgaagtattaaatggcattgcaaagcaagtacctttcttcattggcgggtctgctgaccttgcaggttcaaacaaaacaacgattaaaaacactgacgattttggtaaagagaattatgccggcaagaacatttggttcggcgtcagagaatttgcaatgggtgcagcgttaaacggtatggcgcttcacggcggtcttcgtgtattcggcggaacgttctttgttttctcagattacttaagaccagcgattcgtcttgctgccttaatgggacttccagtcacttatgtctttactcatgacagtatcgctgttggtgaagatggtccgacgcatgagccggttgaacagcttgcttcattacgtgcgatgccgaacctttctgttattcgccctgcggatggaaacgagacagctgcagcgtggaaactggctgtatcttcaacggataaaccgacagcactagttctgactcgtcaaaaccttccaacgattgatcaagcacctgagaaggcatatgagggagtagaaaagggtggatacgtcgttgttgaagctgctgatgcacagcctgaagcacttctacttgcttccggatctgaagtcggcttagcgattgaagcgcaaaaagcacttgaaaaagaagggattcgcgcgtctgttgtcagtcttcctgcatgggatcgtttcgatcagcagtcagacgaatacaaagaatcagtccttcctacagcagtacgggctcgtattgcgattgaaatgggggcttcacttggctgggagcgttacactggtcttgatggtgacgtaattgccattgataaatttggcgcttctgcacctggtgaaaccattattgagaaatacggttttacggtcagcaatgtcgtcagccgtgtgaaagcgaagctgaacaaataaccagtctccaagcatcatgctttttttcatctgtttgcagagcattttcatccgctctgcaaacttttttcttttttcttgtttttttgacaaaactagtttcttcttgcttcatatatagacaattctttctttcacatttttgtataatacaagcaatatacgagattgacgaaatgtgaaaggaagggatagacatggaacgccattattatatttattggattgaggatgaatttgcccatcattattttggcagagaatcaattttgtttcatttgtttgagtcgttacactggacgaaccgcacggaagatgaattggtgatgcttgtgaaacaagtggattacgtgacgaaacgaatccctgcttttcatatgcaccagcgattaatgaacaacttaacgaatattcactatacacaaattggctcgatatacagcgcttccttacctgatggaaaaggaacggctgcatttatcataaaagatcgttatatccaaatgtctgccaccggcagttatgaagcagaagcagtgttttttgaagtgctgagaaaaattagtccttgcttccttgcgatggacttcggttcaaagaagcacgggtggctcaatccggtaaaagtgaggaattttgtttaaaaaaataaaattgaacgtgaaatgttgtataatagccttttgtttagtacactttatacgagacaacatgaaggaggaagaattatggatttatgggttgtcatccttgtaggcgttgttgcactgcttgcaggagttgcactcggattctttattgctcgtaagtatatgatgagctacttgaaaaagaatccaccaattaatgaacaaatgcttcgaatgatgatgatgcaaatgggcatgaaaccgtcccagaagaaaatcaatcaaatgatgaaagccatgaacaaccaagcgaaataatacgtacgatattatgatcatagatggaacatggttataaagaatggacaagcgtttgtcctttctttattgaattcaccttcatcagacgctttaaaaccactgtacttgcctaaatgaagcagggaaggtggtttttattttggcttcagcttcctgctaaaaaacaaaaacccctgttatcagaggtttttgtttcgtttatggtcacacatatcaactgttctaaaaatcgtgtagcatgataatatcatgagatatgattagttggctgagtttgagtgtaagtgtcgttgatattgtaagaggagatgatctagctgctggctatgttcgatggtcactgtggatgtcatgccattgtgcaagacaactttcatcagctcttctcttttttcttcgatttgagttaataatgatgtttttaccaaagtcatgttcctttcatgcaaatcttgataaaaagaatcgattctattatatccattttaaggtttattttcaaatttaaaggattcgttatcttgatgtcaaattaaattatataaggttttaagagaatagaccatctttattgagaggatgtaaaaaaaatgaaatgattttgtcatctcttattgtatattgtaagaagggggtgctcttttgacagatttgaatttctttttagcttttggagcagggtttctttcttttatctcaccatgctgtctgccgctttatccagcctttttatcgtatattacgggcgttagtatggatgaagtgaaatctgagaaggtgatgctgagaagaagaagtctacttcataccttattctttttagttgggttctctattatctttattgcgattggctttgggacatcgtttgttgggaagttttttgatgattaccatcaagcgattcgccaggttggagccattctcattattttctttggctttatgacgcttggtgtatttcagccttctttcctcatgggcgaaaagagaatgcagttcaaaaaccgaccagctggtttttttgggtcaattctcatcggaatgggctttgccgctggatggacaccttgtacaggacctattttatctgccgttatcgcgcttgctagtaacaatccagagtcggctgtgccttatatgattacatatgtccttgggtttgccgtcccattttttattctatctttcttcattacgaaaatggcatggatcagaaagcgtcagcagcttattatgaaaattggcgggatcattatgattgtggtagggatattgctgttctttgatcttctcacatggattatcatcatgttctcatccttgtttggcggatttacaggcttttgaaatcgttttctacagtcgcggcgaatggttttttttcgtcaattggagtatattatacataggctgaccttaaagaataaaggaatgattagatatgatggtcataatctcttctataattgcggtatgtatggcggtagccgtcatgtttattcgcattaagtcatctgcaaaaccggcaactgcaaaaaaaattatattgcctcctattttcatgagcacgggtgcattgatgttttttgttcctatgtttcaggtaactggggctgaatttctcgaggcaatcacagtggggatgtttttctccatctttttaatcaaaacatcgaagtttgaaattagagggaatgagatttacttaaagcggtcaaaagcatttgtgtttattctcattggacttcttgttcttcgtattggaatgaagacaatcctgagttcttctattgattatggttctctaagcggaatgttttggatacttgcctttggcatgattgtgccttggcgagttgccatgtatttgtcgtttagaaagatgtctaagcaattagatccgcagcaggttcaaatgaattaaattcagattgttgaaaaagggctaaatctttattttagccctttttcttctttgaacctcctttttaaaaggaggttattttaataatgcttcatatggcgtatgatcgatgtttttttcttgaaggcgcttcaataaaaacttatgatcacgctttggtgtagcgataatatagccgcgaatgattaagtctaaattaatgctggcagcttgttcttttaaagccagctcgccaatttttcctgcaattttttctttggcgacatctctaaacagctctggaacaggtaatacaagttcatttaaaagctgtttgtcttcttcccgccataggtggaggctcttttgaatatattcatcctgccaatcaagctctgatttcccatcttcctttggcaatcgttttaaaaatttgcgaaacataaaaaagccaccgattgcgagtaatccgatcatcaccgtaccccaaaataaaatgaaccacaaaaaccagccgcttaacatgttctcactccttataccccttgtctctctatcttattttacatgaagaaatgatagaagaaaataacaaaaatgtatgtctcttatctctatgaacgccttttttcattcataactgcccatttactagaaagacccaaaccatctagtagaaaaagaatacattatcatatagcgactctactatttggccatggtggttcgcaaaaggtattgacttgacacgaacggaagagagcccacctatatgaaggtgggctcttaatgtttgaagtgcgggacttgaaaggaaaatgcaccgtttggatggtcagaacttttattaatccttatcgaaatgattcggttttcgtattctgtttcaatctctttgtcgttcaaataaaaagggagcatgacacttttttcaattggctgttcgcctttatcatttggctgttgtactgtgtaagcgagagtgagctcatgtccagcgaaggttagttttacatcagtgatcgatagggtggagacatcgatttcgataatataatcacggcttgtttcataaagatcaattgggaggtgttcatcataccaggcaaatggatcatccattaaaacattgagccaatcgtctatttcaagaaaatcagaggaattcgattgcttttcattctccataaacactcctccatcacatctcataataaatcatatgatgaaaatggaaatgtgtgaaagacctaaaacatcccgttttgctacgggatgagaggagaatgtttacatatcgtgatgagaattgtgtttttgtcttgtatggttgcggttttttacttttttactgcctgataatggctcaggctgtccgctctgatgttccttaggcgagttttgacggatgtcttttcctgtgtttttattcgtcatgatgcttgctcctttcttattggttttttttgcgttttttattgttttgtctttgttcttctgttaaaacgagttgatcatcttcaatatagcctgcaccatttccttggcttttggctgcgttcatgccattaatgacatgatttgctttgcgttttgtcatgttctatcacctcatttgtagtatgagcccgccccgcttcgtttatgaagagtaatcatttcctaatgataagttaaacttattgaatttaataaaagcattgttatttacttatgtatgaatttgttttaagatgaaattgtgagaaaattgtggtgaaatacgacgatttttctgagaattgaaattgatcttgatcatcaaaagggggattttggacatgtcgaaacagcagcaagtcgctaaacaagacgcttttcaatctagaaaaacgttttcgacaaatgggaaaacgtatcactattattcgttagaagcactagagaaacaaggaattggaaatgtttctaagctgccttattccattaaggtacttttagaatcagtgcttcgccaagtagacggtagagtgatcaagaaggaacacgttgaaaacttggcaaaatggggaactgccgaggtaaaagaaattgatgttccatttaaaccttctcgtgttattttacaagacttcacgggtgtaccagccgtcgttgaccttgcttctttaagaaaagcaatggcagatgtaggtggggatccggataaaatcaaccctgaaattccagttgaccttgtcattgaccactcagtacaagttgataaagctggaactgaagatgcattaaacattaacatggatttagaattcgaacgtaacgcagagcgttataacttccttagctgggcaaagaaagcgtttaataattatcaagctgttccgcctgcaacagggattgttcaccaagtaaacttagagtaccttgcaagtgttgttcatgcgattgaagaagatggcgagatcatcacttacccagatacattggttggtactgactctcatacaaccatgatcaacgggatcggcgtacttggatggggcgttggcggtattgaagcggaagctggaatgctcggtcagccttcatacttcccagtaccagaagtcattggtgctaaattagttggagagcttccaaacggaacgactgcaactgacctcgcactaaaagtgacacaagttctgcgtgaaaaaggcgtagtgaacaaattcgttgaattcttcggacctggagttgcacagctgccgttagcggatcgtgcaacgattgcaaacatggcacctgaatacggtgctacttgcggattcttcccagtagatgaggaagctcttgcttaccttcgccttactggacgtgatgaagagcaaattaatatcgttgaagaatattctcgcgcaaatggcttattctatacgccagatgcagaagagccaatttttacggatgttgtggaaattgatctttctcaaattgaatcaaacttatctggtccaaagcgtccacaagatttgattccactttctgaaatgaaagaaacgttccatcagcacattgaaagcccagctggtaaccaagggtttggcttagaaaaatcagagctggataaacaaattgaatttgatctagcaaatggtgaaaaagctgtgatgaagacaggtgcgattgcgattgcagcgattacgagctgtacgaatacatcgaacccatacgtcttaatcggagcaggtcttgttgcgaagaaagcaagtgagcttggcatgaaggtgccaaactacgtgaaaacgtcactagcgccaggttctaaggttgtaacaggatacctcgtgaactcaggacttcttccatacttaagagacctcggatttaacatcgttgggtatggctgtacaacttgtatcggaaactcaggaccgcttgcacaagaaattgaggatgctgtctctgaaaatgatctgctgatcacttctgttttatcaggtaaccgtaactttgaaggacgtatccatccacttgtgaaaggaaactaccttgcatctccaccattagttgtggcgtatgcacttgctggtacggtgaatatcgatttaacaaaagaccctatcggtgtcgataaaaatggtgagaacgtttatttcaatgacatttggccatcaatggacgaaatcaacagcgtcgtcaaaagcactgtcacacctgaactcttccgttcagagtatgaaactgtttttgacaacaatgatcgctggaatgaaattaaaacgacggatgatgcattgtacaaatgggatgaaaattccacatacattgataacccgccattctttgaaaacctatcagttgaacctggtaaggttgaaccgcttaaaggcttgcgtgtcgttgcgaagtttggtgactctgtcacaacggaccatatttctcctgctggagcgattggtaaggacacaccggcgggcaaatatttgcaagaaagaggcgtgtcgcctagagactttaactcatacggatctcgccgtggtaaccaccatgtcatgatgagaggtacttttgcaaacatccgtattaagaaccaaattgcaccaggaacagaaggcggatatacaacctactggccaactggtgaagtgacatccatttatgatgcatgcatgcgttataaagaagatggaacaggtcttgcgatcttagcaggtaaagactacggaatgggttcttcacgtgactgggctgcaaaaggaacaaatcttcttggaattaaatttgttctagctgaaagctttgagcgtatccatagaagtaaccttgtcttcatgggcgtacttcctttacagtttaaagacggagaaagtgcagaaactcatggtctaacaggaacagaaacatttgaagttcatgttgacgaaacagttcgtccgcgtgatctcgtcactgtgaaagcaattgacacagatggcaatgagaaaacatttgaagtggttgttcgttttgatagtgaagtcgaaattgactactatcgtcatggcggtatccttcaaatggtacttcgtgaaaaattggcaagcaactaatactcatacagcaaagaagagaaggcgcctagacagctttctcttcttttttaaaatagtggaggatcaatcatgtggaaaaaaggaatggcaagcgctgttttacttgtgttgattggtttacttgtgtggaatttacttgaaccaaaagagcccgcaatcggtcttgaaaaaggggatcaagcccctgattttgaacttaaaaccctagatggtcaaacggcttcattatctgattaccaagggaaaaaggtgctcgtcaatttttgggcgacatggtgtaagccatgcaggacagaaatgccggatctagacgcaattagaagcgaatacgatcaggtcgaagtacttgcagtgaatttaacgaccactgaaaaaagtgaagatcatgttgcagcttttgcagatgaattaaagctgagctttcctattttattggatcaaaaaggcattcaagcacgatatcaggtgctttcataccccacgacatacatattagatgaaaaaggacgtatcatgtctgtgaagcatcaaatgctgacaaaaaaagaaattgagcaagagctggatctataatgattcagcttttttgcttattttctaaatgttttggcgaaaatgaaatacaaacactggaggtgagtacaatgagaagaagaaaacgccgtacatttgaagagcttgtacttgaaaataaaaaagaattattaagcaatgaggaatttttaaaccagcttgaagaaaagttggaagagcgttttagacagaaataagttatgaattgtcctttttcgttcatcctaaagaagagggagggatgaatgatgggtagagagcatgataaacaagcgcagtttacaccagaccatttagggacaaaacctgtagcatacaaacgcaataaaggtaaaaagatgcataataaatcaaatgaacagcctgatgtgatccagacgaagggcgaataaggagggtattaagatgaatgaaaagtcatatcaatccaatccagatgatcgttctgataatgttgaaaagctgcaagatatgatcgaaaacacccttgatcatatcgatgaatctgaagcagcgatgggcctttcgacagatcaagaaaaacagataatcaagcaaaaaaatgaaaatcgaaaaatgagcattgatgccatgcgttctgagatcaaggacgaagaagcagcaagaaaaaatggctatactgaataaaccagggattcctggtttattttattgcctccttttagaagaaccatttcgattgtggtaaaatggcagagaccttaggttttgataggagagcgatgaaaacgtgtatgtatctaaaaaagaaatagaagtccgttatgcagaaacagaccaaatgggcatcgtgtatcatgcgaattatttaatctggatggaagttggcagaacagccctgattaaagaattaggattttcctatgcgcagctagaagcagacggcgctcttgcacccgttatagatttgcaggtgaaatataaaaaacccctcctgtatggtgaaacagcgaccgtgcatacttggattgaagaatacaatggactcaaaacggtgtatggctacgaaattcaaaagcctgatgggcaaacagcgattacagggacaacctcgcatatttgcgtagataaagacacctttagacctattcaatttagaaaagcatttcctgcctggcacaaagtatatgaacagtcgaagaagcaggtttaattcatggcgtttggtattaaaagaagcgatttaaatgcgtggaaatcagctgttcagcaaggagaaatggcctttttaacccattattggcttgatgaccgtttcccgcatgctaatacagtcactaaagcagcctgtcaggatatgaagcagttaattgagtggggagaaaaacatggactcaaaaaagaatggattcacgaccgcgcagggtttcctcactttgacttgatcggtgaaccgcaaaaaagaatcctgcaaaaggagcggtctttaggaaacattcaggagtatgggttatatattgaaggataaaacaaaaaagatacccgagggatgaggtatcttttttgtttattcataatggaattctggttcttttacagactcgttataatcaatatgcagatcatggttgtcaaaataccaaatatcactttcttctacaaagaaagtaataccttctatttcagcggttgcgccggcattttgaggttcatcttttgcgacgccgagagaaaagcctttttgtacattactgcacccgccatatctcacaaaaaagcgaacttgatcacctttttctaaatctaattcatccttgtaccaattgagtgcatcttctttaatcgttaatttcaatgtgatcgccccttttttgaagtcatgctgttttttaaaatgcaggatgcaaaaaaacagcttttctttacttttaccacagaatgaaacttatgaaacggctagagccatttgattttcggttcagttttgttgaggattcgtttgaggttggcgatgtgtctgtagatcacaaaaccagcaagaacggcaacaacaatgattaagaatacgtctttggtgaatatgctgtaaatgaatgtatagatgccggtcagcatagatgataatgaaacatatttactaatgtataaaaataagaaaaaagcagcgatcatcgtgataaataagaacggggcataaaataataacacgccgccagatgtagcgactgcttttccccctttaaattttgcaaagatcggaaagctgtgaccgataacagcagcaacccccgctaataagggatgaatgtccagttgcatgaaaaacggtaaagcagaagcgagagtcccttttaaaatatcagcagaaataacaatagaccctgcttttacgccaagcgtacgaaatgcattcgttgcacctaggtttccgctgccatgttcacggatatcaataccctttgcagctttcccgacaatgagaccggatggaatactgccgagaagataagccaaaataaacatcaaagcaattaacatctgcataactcctttatattctccctcttgtcttacattttaacatgatcttatgaaaaacatggggatctttttttgaaaaaatcaaatgcagatggattcagctttgtttttaagcagaagttcgctaaaatagaggaaaaggggtgtttggatgaatcatccttcgaaacaagaaattggccgtattttaaagagcagtaaacgaattgctgttgttggattatcagatcagccgcaccgaacgtcttatatggtgtctaaagcaatgcaggatgccggttatgagatcattccggtgaatccaacgatcgatgaagcacttggtgtgaaagcagtcgcttcactaaaagagatcaaagagcctgttgatatcgtcaatgtgtttagacgttcagagtttttacccgaggtggcagaagaatttcttgaaatagacgcacctgttttttgggcgcagcaaggcatttatcacgaagaagcgaaaaggctgattgaggaaaatggcaaggttgccatcatggatttatgtatcaaggtggctcatgcaatgacaaaaactcattaaatcgtcaaaaatccttggttttcaaggatttttgcttttttgttgcagaaatatatttgcgattctagaagaaagcgataaaataaggcgacagggacatatcggtgatcttgcatatcaagaaaaagagcgataagataaagatagaacatttgttctgttttgtgaaaatcatcatatgattgcatttggcttatcaaacagtcttgtttataatggacttctagttctcattgcagaatgtagaacattctcatagccgtgcaatggagcatgtttttttgaaccacacatgcatggtgatgatgcagcttattaaagtggacagtaatgagcagcatgatcatcattaaaatctaaagagatcatttgatggtttgccggttatgtttgttagtgaaaggggattaagcatttggttaaaaagcagcaagtagattataacgatgattctattcaggtgctagagggacttgaagcggtccgtaaacgtccagggatgtatattgggtcaacggattcacgcggtcttcatcaccttgtctatgagattgtagacaactctgtcgatgaagtactcgctggccatggagatcatatcgttgtcaaaatacataaagataacagcatttccgtccaggataaaggacgcgggatgcctactggtatgcataagcttggaaaaccgacacctgagatcattttaacggtccttcacgcaggcggaaaatttggtcaaggcggatataaaacaagtggtgggcttcacggagttggggcatctgttgtaaacgcgctgtcagagtggctcactgtcacaattgaacgtgatggatatatatatcatcagcggtttgaaaacggcggaaaacctgtgacgtcacttgaaaaagtcggaaaaacgaaaaaaacgggaacactgattcattttaaaccagatcgatcgatgttcagcgttacaacctataattttgatacgttatcagaacgtttaagagaatctgcctttttattaaaaggattaaaaatagagctgattgatgaacgacatgatgtacaagaaaccttttattatgagacgggcattgaagccttcgttgcttatttaaatgaagaaaaagatgttctgagtgaagtggtctcatttgaaggagagcatcaatccatcgaagtagactttgcttttcaattcaatgacggctactcggaaaatattctttctttcgtcaataacgtgagaacaaaagatggcggtacgcatgagtctggtgccaaaacggcgatgacgagagcctttaatgaatatgcgcgcaaagtagctcttttaaaagaaaaagacaaaaatttagaaggcactgatattcgcgaagggctgtctgctattatttctgtcagaattcctgaagaactgcttcaatttgaaggccagacaaaaggaaagcttgggacaagtgaggctcgctccgctgttgatgctgttatttctgaaaagctggcttatttccttgaagaaaaccgggaaacagccactcttcttgtgagaaaagcgattaaagcgcagcaggcaagagaagctgctagaagagcacgtgaagaagcaaggagcggcaagaaacggaaaaagtccgaagcaacactgagcggaaaattaacacctgctcaatctagaaacccggcaagaaacgaattgtacctagtggagggcgactcagcgggcgggtcagcaaaacaaggacgtgaccgtaaattccaagcggtgctgccgcttcgtggaaaggtcattaacacagaaaaagcgaaacttgctgatatttttaaaaatgaagaaatcaacaccattattcatgcgatcggtggaggcgtcggtgtcgattttaatgtagaagacatcaattatgacaaaatcgtgatcatgacagatgctgacacagatggagcccatattcaagtgcttctgctaacgttcttctaccgctatatgaaaccgctgattgagcatggcaaagtgtttattgcactaccgcctttatataaagtcagcaaaggctcagggaaaaaagaagtgattgagtacgcatggtctgatgaagaaatggatgacgtactgaagaaagttggaaaagggtacacgattcaacgctataaaggtttaggtgaaatgaacgccgaccagctatgggaaacgacaatgaatccagaatcgagaacacttgtcagagtcaaaatcgacgatgctgcacgagttgaacgccgcgtcacgacattaatgggtgacaaagtagagccacgtcgtaaatggattgagaagaatgtcgcctttggacttgatgaggaaagtaacattcttgaaaatgaaaacttgtcgctagctgaggaggtttaaacatggcacaacaagaacgatttcatgatttaccattagaagaagtaatcggagaccggtttggtcgctatagtaaatatattatccaagatcgtgcgcttccagatgcgcgagatggactaaagcctgtacaacgaagaatcttatatgcgatgtacgcagaaggaaacacgcaagataaaaacttccgtaaagcagcgaaaacagtcggtaacgtgattggtaactatcatccgcacggtgactcatctgtttatgaagcgatggtgagaatgagtcagaattggaaagtacggaatgtgctcattgagatgcatggaaataacgggagtattgatggtgatccgcctgctgctatgcgttatacggaagcaaggctatctgcgattgcatcagagctattaaaggacttagacaaggaaaccgtcgaatttgtcgcaaactttgatgatacaagcaaggagcccgttgttttaccagcgatgttcccaaaccttctcgtgaatgggtcaacaggtatttctgctggttatgctactgatatcccgccgcatcatctaggagaagtgattgatggtgtcattaaacgaatcgaacagccgcattgtacggtggaggacttgatgacggtcatcaaaggtccagatttcccaacaggcggtatcattcaaggggtagacggcattaagaaggcctatgaaacaggcaaaggaaagatcatgattcgcggaaaagcggagatcgaaaccatccgcggcgggcgccagcaaatcgtgatcacagaaattccttatgaagtaaataaagccaaccttgtcaaaaagatggacgagttccgaattgaaagaaaagtggaaggaatttcagaggttcgagatgagactgaccggactgggcttcgaatcgtagtagagctgaaaaaagaagcagatgcaaatggtgttttgaatttcttatataaaaactcagatctgcaaattccatataactttaatatggtggcgatacataatcgtagaccaaccttaatgacgctgacaactatacttgatgcatatattgcccatcaaaaagaagtggtgacgaatcgctcagcatatgagcttcgaaaagcgaaggaacgccaccatattgtagatggattaattaaggcgctatccatcttagatgaagtcattgccacaatccgctcctctaatgataagcgagatgcgaaaaacaacttgatggagaaatatgactttacagaagcacaatcagaagcgattgtttccctccagttatatcgtttaacgaatacggatattacgcaattaagagacgaagcgagtgagcttgatgtgcgtatagcagaacttgaagacattttaggtaatgagaaaaagctgcttaaggtcattacaaacagtttgaaaaagctcaaaaagacatatgctgatgagagacgatctgtcattgaggaaaaaatcgaagaaattaagattaacctagaagtgatgattgcctcagaggatgtttacgtcacggtgacgaaggatggatacatcaaacggacaagccagcgctcctatgctgcttctaacggtaaggactttggtatgaaggatacagaccgcctgattcatcagtttgaaatgaatacaacggatgtcctcctactattcacgaataaagggagctacatttattgtcctgtgcatcagctgccagacatacgctggaaagacatggggcagcatattacgaatatcatttcgattgatcgcgatgaatccatccaaaaagccattccaattaaagaatttgatgaaacatcgtatctgctgttctttacaaagggcggaatggtgaagaaaacagagcttcttcaatataaagcgcagcgctattcaaaaccacttgtcgccttgaacctaaaaggggacgatgaacttgtggatgtccatgtgacaacaggacagcaggaattgtttattgcgacgaaaaatggttatggattgtggtttgatgaagaagaagtaagtgttgttggtccgagagcggctggtgttaaaggcatcaatttgaaggatggggacgaagtagtctctggccagatcattgatccgaaaaacgatgtcctcgtgctgacgacgcaaagaggggctgtgaagcgaatgaacctctctgaatttgataaaacatctagagccaaacgcggagttctaatgcttagagaattaaagaaaaatccgcatcgtattgtgtctgtcatcgctgcatcactgcatgatacacttgagattgacacagagaagggtgcaacgattccgcttgagatctctactctgagagcgaatgaccgctatagcaatggatcatttattgtagatgaggaagagcagggagaagtaacgcatgtccttgtcacacctcaaactgcaccagatgacaataaataagcaaacgaaaaccccctgcgatgagcagggggttcttttatatacaggtctttgtcttagctctcgtggttgccaaacatgcttgtaatggcgtgcactacttcaattccttggtagacgaaaagagaaagtgaagtgacagagaataaacctagaatgaatactcttaagaaaaataacatcgtgtaaaacctcccaattttgttttgatttagatggttgggttaaacacgagatagtcggaaataagaagattgatagaacactgcaagtaaatgcttctttttccggtcatattgatcagtatgagtgatgcgtgcaaatccagctgtcatactgccaattatcagcagtactgtaaatgcggcaaatactgcgctcacatgtttttgtttcttttcatcgcccatggtctgagcgattttcatctcatgtgattcttgatcggcaaccacctttgcatggtggtatacctgaacggaatgaggcattgagaacaaatgaaaacttgcgagtgctatgaataagacagctaattttagcagcatattttttttcatttatctcaccccttcctgtttattttcatgatcttaccacgttttctgttatttgaaaagtcttatttttttactttccctctttaaaaaagcgataaacatcaggacatttataggactgtttcacttcatgaaaggtttcaattttatttttttaatttaaaaaaagtgccatgatcgaggaccagacacttttagtgaacttgtgatgtatgcggttttgcgacagcttttgtaaagattcccgcaatacatatggcgaataaaacaaaaataaaggcatgaagcagtcctacttgattggcaagcagccctaatataggcggaccagaaagagaggcggtgtaacctgataaggtcacaatgctgacgcgtttcacggcgtaccggctatcatcaccagctgcagaaatagttaacgggaagcctaaagaagccccaagtccccataaaaagatcgatatcatacataccacaagtgaaatctttaaaatgaccaaaaatagtccagcagcagctgatacaatcgcaactcttagcaataacaccctgccgaaatggtcaatcaaacgtccgctgattaatctgccgctaatcatcccgcataaaaataatgcatagatgactgtactcatggaatgagaaacctggtagccatccaccattgcaagtggaatccaatcattagcagacccttcgacaaacgcaagacataaggcgatcatggcaagagagaccgttcgtttattcagccacggcgtttgagtatcatctattgtatctgactgcgactgcttctcatgctgatccattccagtcccgtgcggaataaaccgagtacaaatgaagatgctgagaaagaaaagaagggcaatgacaagtaagtgattcaacacagagacccctagatggataaaaagaatgccagctcctgctccaattaaagtaccaatgctaaaggaagcgtgcaatataggcaaaatggttttcttgattctgtattcaatttctgtcccttctaggttcatcgccacattgcacatacctgaacctgctccaaaaagaaatagtccggccgtgacgacaaagatagaagagagggttgaaccaatagcaagagtggtgaatccaagaaacatcaaaaaagcactaatcacaatcgccactcgtccgcctttttttcgaacaaatacatttgaaagaacaagcccaacaattgaaccaacggataggccgagtaaaatgagtcccatcgttcctgtattggcttgtaataaatctctcacttctggtgtccgtgaaaaccatgtagatatggaagtaccagacatcgtgaaaatgatgatgattgctttataccactttaattccatgtaatccctcacatttaaagatgtatctgttactgaacaaatctactcgattataaatgagacggaccaattcgtaaataacctgaggcaggaacaggggcaattttaggcaaaagaaatcatactttcccaattcttctgaggagaaggtaaaataaacataaaggggatgtatcaggataaatagaaggagagaggactaaaatatgaaaagtgaaaaggaaaaaatgatccaaggagaacattatgtatctagcggccaaaccttgatcgcagatcgagaaagagcaagacaattgcctttgcataccagcaaaccaacattttaaaggaattattagacacttgcggaaatgatgtcgttttcgaaggaaggcttcagtgcgattactgatacaatatcgaggttgacgagcatttttttgcgaattttgatgcggtgttgcaaaattaccattggacatcattgtttattaggatcgaatgtacgtatttatacggctggacatccgctcaatagaacgtgcaaaaggcattgagttcgtattattaatccaggtgtcaagattggcgacaatgcggaagtcattaaatatctggatgaatcaaaatttggcgaatatcgtagattgtggattttttctttttcgtctcaataagataagtatacttagatttgagacaaaagaattgtattcgttgtataacttcctagaatatatattatgtaaactaataaataaagatataggctgaccccccaactggtagccccttcacattaattccgtaatcaattgaatggttatgtcttatctattaattaatgcaaaaaaagagagcctttaacttggccctcttcattaattgtatttgtctcaaacttagcacctatttctcagtctcagcaaactgtttcaatcgatctccaatttcatctcttaccctttggaaaaatgcccatttctcttcttctgttccttctgcttttgctggatcatcaaagccccaatggacacgttcgacatgaggaggagtcatcgggcatttatcagctgcatcaccgcatagtgttacgactaaatcagcgtgatgcaatatcttgtgatcaatcaggtcagacgtttgattagatatatcaatccctatttctttcattgcttttacagcattcggatttaatccatgagcttcaataccagcgctatagaccttccactcatctccaagatgttttttagcccaaccttcagccatttgactgcggcaagaattaccggtacataaaaagtatattgttttctttgacatgttgattgtctcctttaatgtataatcattagccagaaatacagcgctaaaagtgtgatgaatagtgttggtacagttaaaatgacccctattttgaaatatgtgccccaggaaatcttcactcctttttgagaaaggacgtggagccacagcagtgttgctaaggagccaatgggcgtaatttttggtcctaaatcagagccaatgacatttgcgtatattaacgcttctctcatcattccttgtgtatcggtgccggatatggctaatgcatcgatcatgaccgtcggcatattattcatgacagatgaaagaattgctgcgataaatcccataccaagagtccctgccaataaaccttgatctgctacagcttgaatcacgcttgaaagagcatcagtaagccctgcatttcgcatgccgtagacaacaacgtacatacctatggaaaagaaaacgatcgcccatggtgcttcttttagtacgctttttgtttgaacagcagggcttttttgtgcaaggattaagaaaaaaatggcaatcacacccgctatgaacgatacaggtatagataaaaattcacttgtaaaataaccaatcaacaaaaaagctaatatataccatgataatctaaacatctttggatcttttattgcttcattaggttgctttaactcagtcatatcatagcgtttaggtatactttttctaaagaaaaggtacagcacagtgatactcgcaagcaatgaaaaaaggtttggaacaaccattctggttgcatattcaataaatgtaatgttaaaatagtcggctgttacaatgttcactaaattacttacgacaagaggaagcgaagttgtatctgcaataaacccacttgcgataataaaagggaatacaattttttcattgaagtgtaatgctctgaccatggctaaaacaatgggtgtcaaaataagtgctgccccatcgtttgcaaataaagcagcgacgattgcaccaaggatggtcacatacacaaacatacgtagcccactgccttttgcagcctttgccatatgcaatgctgcccattcaaaaaagccgattcgatcaaggatgagtgaaatgatgataatggcgacaaaagctaaagtcgcattccaaacgatgcctgtcacggtgattacatcgtcaacattcacaacacctacgattaatgctaaaatagcccctccacatgcggaccaccctatggataaattttttggctgccaaataaccaataccaaagtgaacagaaatataagtaacgataaaacggcaaaactcaaactcatccctccttacgaacaagaaatgtttgttgctttatgttgtatactttttaaaaggtcatcttctttatcaatttgatttaagatgatccgaatcgtctcaaattctggagacagtgaattgattgaataataacgccactgcccttttctgttctcatgaacaaatccagctttttttaattttcgtaaatgctgactaatagctggctgactcatttcgaacatatctaccaattcacacacacaatattctttctccaaaaacaatttcatcatgatcagtcttgtttgatcactgagtgtttttaaacaattcgacatatgtgtcacaccaattgaaacatctgcagtcacaatgattaccccctcttttcaaaaattggtgacggtcgtgttattaactcctccaacagtatataactaaaatcttatataatcaattgattatatgatttcaaacaaaaattgattcgtgtgaaaatgattgatttacttcaaatgaaaccacatatttatttaaatagcccagttctccatattggcaaaaaaggtgttgataaccctaacccaataaatgctgaagggattatgacagaaaatgaaaaaagagtggctgatcgaatggcattcctgatattttaaatcgcggatctgactcagtatcagcattaaacagttgcagcagttggcagtgggcattctgctgttaacacttagctcgagctgccaaagctaaaagagacatcaaaaagcacagaaatgatatggattttaagaaagcaggatattagtgaggtattaagaggagaaaacaatgatcaattgcctgcaagaggtcaattagatggaaaggacccttctttgtgtcctttgatcagaaggtgaaagagggtccattaataaagatacagttattgtttcgactaattaaaggacccttgttcttgtcttggtacaaatcagatagctcataaaggtttttggggtaattccattatttgaatctccatcccccatgaagttgtgatatagaaaaatccaagagggctcagctctctaactttaacatcaggctgttctgcaaaatattttaaagcctcttctatactggtcactgtaatagctagatgagctacaccgatatcactgggttttaggtgaacattctgttgatctggatctggcgtcgaccattgaaccagttcgatctttctaccgccatattgcaaaaatgccgccccttctacaactgaatgttcgtgaaccccaaagtatctctttaaactatcgtcttcaaactgcatccgtcctggccggaacaagacttcaaaacccaaaatattagtgaagaaatcaactgctacttcgatatcgggtactacaaatcctgaatgctcgattgtgccttggaaaattgtatttttcatatcgctaaacccctttgattttttggaagtaaatgattcatgataaagtggtatttaaagcagctatatcacacgagcaccaattaggttcaatacaagtcaagtaatgttggcactattacaagatttagaacaacaatacctgagccttgaaatactataatattcttttgtgatttctgaatcttttttgaatatccattaaaatttacatgttccatctgaacaatcatcatcgagcgacgactctgatttatgctcttcaaccttagagttcgcatactcttctttccaaacctgttgtaatgtttctaaaaatacttcactaggctgtgctcctgagatgccatatttatcattcactacgtaaaagggcacgccctgaatcccaatttttgatccctcggctctatcagctgcaatattctcgctatatttatcatttgctaaaacatccaaggcttcgttgccatcaagacctatctcacttgtaagttgagcaagtgttgcatggtcaccgatatctagtgaatccgtgagatgagctttcatcatacgctccataaactcctgtatcttccctttctcttttgcataataagaaagacgaagtgcatcatatgaattcgtaggaatcaatgtatcaaattgataatctaacccaacctcttttgctttctgtttcaattgattgtttcttgcttttgctttttcatatggaataccatgcttggaagatgctacttgatggatatccattcctgtatttttttttgcatatggatctaattgaaaatgacgaaataagacttcgacctcttctttatgttcaaactgttctaaccctatttcaaattgacgtttgccaatataacaaaacggacaaacaaaatcagaccaaatttctactttcatcatatgttccccctttatgattttgatgaatgtgcgagggggattatgttaataacatctttttaactaatcccaccaaagctcttttttaaaaagttcgtgctgccgcttttgccttttcaattgctgcagcaacaacttcttctttcttagttggatcatagtcaataccttcaacaaaaatcgttggttccacttcaattccaacaaactttagcgcacctcttacgtaagattcggaatgttccattccaattgcctgtgaataaaatcctcccattccatgaatatggattgcttttttccctttcatcaatccttctggaccttctgatgtatatttaaacgtttttccagcactcatgattgtatcaaaataggcttttaataagggttggattcctaaattccacattgaagactgaatgatgtatttatctgcttccataaattgctttgtgaatgcattcactgcttctattttttgtgcttcaacatctgttagcacttccccacttcttaacttcttttgtccagttaaaaaatcagcatcgattaatggcacatttgcataatagacatctacctcaattatttcatccgttggatttacttcctggtattcattgataaatgctctagcaacttgcgtacttcttgattgttcctcactttgaggtgttcctttaacaaataatacttttgacatgatcatttcccctttatgattttgatgaatgttttttgttcctaaacattttttgaatacttattaaaagaatttacacgtttcatctaaacaatattttcgctatgattcctataatttctgctggatcaacaacctcacacaaaaagctgatttaattattatagacaatgggcatttttccgattaattggctttgcctagctgcgtcatacatgagtttagcgacattttctctagatacggacattttagctggctgatcgccgaatgaataaccgtaagattgcccgttgtatttgatattaggattaatgattcgaacgactgtccaatctaggtttgattgtttaatcagttctcctatcttcttcatttcggcataaccatttggcatgagaagtttaggcaatattctcggcaatatcgtcgataagcttttcttatcgtcctcagattgcaaggctggcgttgcgagtgtaatcaatctttttttggtgaacttcttcatcgctttgacaatccgtttatgtccgtcggcgatcggtgtaccttttcgttttcgcgacaaatcaatgccggggcctaaggtgcttaacacgacatcagcttctgaaactgccgtttcaatggctgaagtgttcgttagttcacccgttacaatgcgtaaattcgaatgctttcgcttgattttctcagggtttctaacatataccgtaacgaaatctccattttctaatgcaaattgtgttaaaagttgaccgattgcaccagttgccccaaaaatagtgatgttcatggtcttctatctccttttgttattctgaatgatcacaattatttccttgatcaaaactctttcgtaataacatgtgttatttaagcaacgcgcgttgtataattgatgataagatgaaaaagaataataaacaacaaccaaaatagccgatatgttgtttacgcaacacttctatatgtattgtcgtttttagacacgatgatgaaccctaaaaggagaagaaaaaatgattatgccaaaaaaagatccgagaatacttcgtacaagacaattgattgtagactcttttctttcgttagctagtgaaaaagatttcaaccatataacggtacgtgatatcacagaaaaggctactattaaccgcgctacattttatgcgcactttgacgataaatttgatttattacattctacaatcaccaatacatttacagacaaattgaaaaaaagactaaatgatcacgatggattcaatgaaaaagtcattggaaatatttttctagccatgtgtgatcaccataaagagttaagcgagctatgtcccaaaggttataattctttaggaactattatagaaagtaaaattaaagaggagttacagaaactaatagctgatcttgtgctaaaaggaactgaaaataccattgaattagaggataaacatttggtaacaaccctatctactatgctaagttgggggatatacggagctgcatacacatggaataaggatggaagacctatttcaccagaagagctagtggctaagaccctgcctatctttagaaatggtatgagtaagtattttctttaatgaaactgatgttattatcaattattttagccattttaaagcagcctattattaaattacgcaaaaatcgatattagcataaaacagcttttgtaattggcagtgggcattctgcttgagctggcagagctaaaaaagatatcaaaaaacacagaaatgatatggatttaaatagtggggtatttggaggagaaagcaatgatcaattgcctgcaagaggtcaattaggtttactttaaatagtgggattcttatacggctattgtttatcaggtcatacaatggatctacatttaccttcttgtaaaagtctatcctcttgtttgtctaaatctcgcctctttcaaatttaaaacttctacgaccttctcaataaattaaatcggtcgtagaagttgggccttatttgttgtactgtaaatcaaatattttgggatatttcttttaaaaattgctttctcttttcatctgttgttaagttcactctagaaaaatgaatccatttcgtggattcatttttcattcccaaatcagctagagttctattaataaaaacgctttgaatggcatttccagcttcagattcaatataatccttatctgttgtagatgttgagatcacggttgttttttttatatttgtcaataaacctttcaaagaaccagtgtgttgatcttccgtaaatgcgaaaccccttaacatcactttatcaataaatccttttaaaatagcaggtaaatcccaccaccagacaggaaatataaaaatcaattcagttgactgatttaatttttcttgataatcctttactaattgataaggcgtttctcctttatgaaaatacttcaattcttcagctgtaaaaacaggattaaactcatctttatataaatcgattacttgaaatggttcttgctttgtttctagattttctgttatggaagtcaaaatggcatgattataacttccatcccaaggatgtgcatagacaatcgttttcattattcattcaccctttttctgagttttgcatcatattttgatgtacattcattttattgtatgctataacatactacaagtacggtaatcaaagtgcgatactaactcaaaggagagtgtaaaatgaatgaggagtccttccagacgaaagctgagctaaaagatactggttttgagtatactttgtcattaattggcgggaaatataaaatgccggttctgtatgctttatatactaacggtgctcctgttcgctataatcagctgaaacgtatgctcggaacaatttcgtttaaaacattaaccaacacactaaaagaacttgaagcggatcacttaattcatcgtaaagaatatcctcaagtgcctccaaaagtagaatatagtttatctgaaaagggattatcactgatgcctgtattagatgagatatgttattggggagaggaacaaatgaaaaataattaggtagactggaaagaaagctactacggtttaaacatgctttctaaagtagctttcttctcatcttatatcaatcccattggctcattttgttgatgtgctaactccattccttctgccagatagagagcgttcttcttatctatatcatcatcagggcaattgtgaatcagttgacgcaatctaactgcaacggtcttacaaacatctggcattaagtaactgtcagaatccgaaagattcagcaaaggaatgatgtcatctgtaaagttctcaaatggtatgtccccgccaaaaccctccatatcatctaaattcataccgatacatgctgctaacttgcatctaaaatcatggaagtcggtgtaagaccaatgtgattcgcaatgagtaaaatccaatcccacgattcattcctccgttttcaaattgtgatggtcgatattttcaacatttgcaaaaattactcctgattgatcatataataggtcaacgaggcacgcaacgctctattctaccaaagtcctaaggttattttgatttaattcctgccccgcaaagaggtatgacaatggtttcttctggtttcttttgatatttcatgtagccagccaaattgactgcagatgtcacttcgacataaaatcctttctcactcagtgtagagcgtgcatgtaagatctcatcttcttcaatatcaataaacgtaccattggtatctagtacagcttctaaaatttgtttggagcgtgctggagcagcaatggcaatcccttctgctaaggtccctttattcgtcacaggtgatgctgattcctcttcattttgatatgctttcacaaggggtgcacagtttttcgcttgtatggcaacgattttcggtattttatgaatgaaaccattttcaaataactctttaaagccataatacgcacctaggaggagagtaccgtttccaaccggaatgattaaagcatcaggtactccttttagctgctcatagatttcataggcgtatgttttagtcccttcaaaaaagtaaggattatagacatggcttgcataaaacacgttttcattgtctactgccttttgtgccgcagctgcaatgtcctctcgcgtcccgttaatttctttaatcgttgcaccatgtgcttttatttgagcgacctttttaggtgaagtgtcatcgcttagatagatgtcacaggcaatctcgcagcgtgctgcataagccgcaatcgccgttcctgcattcccgctactatcagcaatcacctttgatacccctaattctttagcctttgtcattagaacagcggctcctcggtctttaaaggataatgttggcatcatgtaatcaactttgacataagtgtttggctcattaggatctagaacgattaaaggggattgaccctcccccattgtcacagtttcccacgtcttagaaccttttggaaatggcatagtttcaacataacgccataatgaatttggatagtgatcccaagctgcgatatctattttcggggtatctttcaccaaatttaatactccaccacaatcacatttccatagagttggtgtcatctcatatttgttcccgcaatggttacaaatcaattgattcatcaatcattcaccccttcgaatatttttttatacgaaatataattttttatatagagtaggcaaaaaaatatcttaaatatatgcaatggcatccatttcaattttgaaaccaaaatgtaattcattcgttggtacaatagtacgtgctggtttatgttcaccgaaaaattcagtataaacagcatcgactttgtcccataaatgaatatctgaaatgtataatgtcatgcgcaaaatgttctcttttttactaccagcagcttctacaatcatctctacatttttaagcgcttgtaatgtctctttttcaatggggccgaattctttttctctcgtttcgggattgatggcaaattgtcctgaaacatagactgtgttttgatgaatggttgcaaatgcatagtgtccgtttgcttttagatttcctacctcgcgtatgctttccatttttgacactccttaccttgatttatttttgatttcatccaaatagctatagacggttactttggaaatgcctaacatagatgcgaccttctcaacagatcctttcattaaaaaaatgcccttttcatccatgaatttcattagttcaattttttcatgacgtttcatgactggatgaacactgttttgaatgatctgttgaatcaactgatctactatttcttccacattttcaagatcatcatttgatgttgtttctttctcatgagcttccacttgtgtagtaagaaaagtatccataaattgctgcatttgattcagtgcttcaacatcaaagttgatacagaaagcaccgatcactttttgctttgaatcacgtattaatgaggtcgaagaacgaatcgtacgtttatcttctgttacaaatgtataaccagcaagataatcttctttaaaattttctgattgtaatacagtctttactaaatgatcaaatgattgaccgatttctcttcctgtcacatggttatttactgtaaacatgacagatgcttgagggttcgttaaatcatgaatcaccacttcacaatttggtccaaacatttttgcagtagattttgctaaaggaatataactttctaataactttttaatatgttccatgcctaagcacctcatttttttattccactagattatatatttttttatatataaaaacaatatatagatttatttatatatgtatcatgatgctcacaagatcaaaatgtgaaaaaaacatataaaaaaagcagccattcattgactgctttttgcttgtgctcctttctaattgatttctttctggattccatacaaaatgacgtcaattccccatcggaaccgttccattgaaacggtatcacctgcaaacatttcttcttttacacgatgaatgaaaggaaaacgcgttttgtctgcatcatcaaatgtttttttaatgtctgaaatctgcgaagagccttgtttcttccaagataccttttcgtatgctacggaagatacgtataagagcaataggtctactccccatgctgcggatgtagatttgatcccgccttcatgcaatgcagcgagaatatgttcggtcaactgaagaaagttcgttccttgtggaatggtggaaagagaaatttcagcgagaccaggtttttcgaatagcagtaggaaataagtatgcaatatgtcaaataactgttctttccatgtgccatcctctgcatttggataaaccatttggccgagaccataatccaatacgtaagcactgagttcttgaacattgttcacgtagacatacaaggatgcaggtcccgtatccaatgctttagccaccttacgcatactcatgccctctatcccttgctccttaagaagctcataggccgttttcacaatcagctcacggcttaagggttctttagccggccgagaccggcgacttataatacgacgatttgaattgttcatactctctttataacatgtcaaagtaaaatagtaaattgagcatcaatcaccgttttcttgaaaagaattcatcatatctgcaagcttgaccgcagcgtcttttgaaaaacacagctttaaactatactccgattcacgagccttttccgatgaatattcgtacatcatgtcttcgtattcttcaatagctttttcaatatgatgaggatgtcggacaatagcaagtgccagctcccttgcatcaaacatcgccatgttgacaccctcgcctgcgaatggcgacatgacgtgagctgcatcaccgataagcgtcactcctttatgacgattccatttaaaaccggtaggaagcgtataaatccgtcttggaatgatggcatcttctgcataacgaatataatttttcagctgatcatcccaatcactaaataactctaataattgttcttttgcttctttcgcttgatgaaacggtataccacaagtctcgatccagttgcgttcgaccataaggcttgcatacactttgattcgtccatctccgtttaattgaccaatcagtcctttgtggtctgctaaagcaaacatcttaccacgtttattaaattcagctaaatcagggtggttctcctctacgcttaagacattcagttccagcatcgtgagcccagagtatccaatctcaatatctgttaacagaggacgcacacgagagaaagcaccatcagctccaatcaaaaggtcaactgtctcgacaaccccgttttcaaaatgaagctccgtcatgccgctttctaatgaaacacatctttctaatttgtatccatatttgatgttttcagcatcaatttgatccagcagcagttcgcacaacacaccacggtcaatttctggacgagtgcctttttgatctgattccgtttcttcatctaaataaatttttcctgatttattaagtaatcggaaatcttctccttcataacgggcatttctttgaaatttctcataaactcctgcttcttttaaggctttttgacctgtttcttcgtgaatatccagtgagcctcctcgttcaagactcttgtcatgaatctcccgttcatagatggttgtttgtataccgtaattttgcagaattaaggcgagtgttagtcccccaggtcctcctccaatgatagcgatttgcttttgatccttagataatgccgtcatcgtatgcatctcctcttcctttatggaaattgtttaaaactacatctcatttgtattataacgaacatcgttcgtaaagaacagtgttcgtttgaaattgtttgtttcacgattgtgttttaatgaaaagaaaccaatcgcccgccatcatgtgatacactccatctaggaatcttaaagatttccattgttcaaactctgagtgtaagaggtgtttctatgaataaattattggcaatgttgatattaggattgggctttagtggtgccgcgcttattctttctgtccctttgttattcaaacccaaaccagaacaagctgagctgttatttgctgctggatcagcgggggctttcgcagtattcgctgtctcatgcctaattcttcgaaaacgattcaatcgctaaaaaacctaaacaaaatccaccgtcatgaacagtggagatttgtttaggtttttgtggttttttaatatgaatttaaagaatgtggtataagctgacaccgatactgagagcgaataaaacaagtgcagggattgcttttttaaagggatctttggccaatacgatcagagtaaatgcagctgccagcatcgtacctcctaacaataagcctgataataatgctaatgttgggatccatatgccggctagcattccagcagcgcctattaactcaagagcccccgttaaaacattaaaaaatgcaggtaaaccaaattgtttgaactcttctgccatttttccagatatgattttcgttcctgtgaggaaaaagaaaacggccaatacaatttgtagaataagaatgaaaatagtgatcacatctttctaagttatttgaccagaaagggtcgcttaatagacaccggtttctggggccatcttgataaaatctcacttccacattgaatggatgaaatttatatgtcatagcatatatcttgcaaaaatagaggttgtttctaccttatagatttatcaagatggatagtctgaatagaataatttgtttaaaagtaattttaattgttcaatctcttcatcacttaattgatttgtcacagttcgatgtgcatccatgacgacaggaagaatcgcctttttgatctcgtcccctttttctgttaaaaacaggtgatgcgagcgccggtcttgttcattatagatttttttgacaagcccttttcgttccattgactggatcattcttacgacagtggtttgatttttatcaatgccttctgccaattctttttgagtcgcgcctttttcacggctaagaatactaataatactccactgctctggtgtaacaccgtatggctttaacctattcgtaaaataattcgtcattttcacatcagtgcgatgaacgagataacctattaaatcatgtaacttcatgtaaacaccctctaattattttatatgctatagcatttatattagtggagcggttaaacattgtcaaattgtctacatgctatgcttaaaatcaattcctgacatgatatatggcaatgctgatttgataaattcttctgaagatatgtgcgaactattttttctccactcaacagaagctccgtgaattccccagcttaaaaaaacagccgtgaccttcaacacttgcttttcgacatttgtatattgattcactaacaactgataaaaaataatttcaagctgttctcgaacaattggagcaagttcagtttcatattctacttggcagcggttatgaagagattgttggaaactggctagcgctttaaaaatattcatcattgtatcttcatctagtttactattgttaaaattgatactttctaaattaattgacaatacttctgagagtgttttatctaataaatcgtatttatcctcaaaatgataataaaacgtggctcggttaatcatggcttctgctgtcaaatctttcaccgtaatatccttaaattcctttttcgatgaaagctttatgaaagactccatgattaatttgcgcgttcttaatatacgcggatctgtctttggctgcgtcatcttcttccccccttctttttaaacacatgcttgaatctgtcggataaacaacaaattgaagaaattattggtattgatctcactcattctgtcttaagattcaattgtaaagcaaatgatgacttgattcaaacaactgatcaggacacattttttcctgaaaaattgaggaggaaacaacttgaaaaacaatgacatgttttgtgatttagaaactggtgtatgcggtgtaggtgaagaagatattcaggtcattgactttcaccaacctaaaaaaaacattacgctctactatgtaacagatccgatttgttctcattgctgggcaattgaacctgtcctgcgccgttttaaagaggaatatggacattattttcattttcagactgtgttaggtggactgctagagaaatggcatgatggtccaattgatcctgcaaacggaatttataagccggctgatgttgcgggtcactggagagaagtcggagaacattctcgcatgccaatagatgggtccttaatgattgacaatcctgttcaatcctcctacccatcctctcgtgtgttcaaagtgattcaaaaacatcacggtgatgaacaagcctatacgtttttacgccgtgcaagagaagcgctatttgcattcaatcaaaatatatcggatatcgcggttttgattgatatcgttaacaaccttggactgaacggagatgtgattttacatgaagcggagctccctagcggacaagacttattaaatcaagattttgctcttgttcgagacctcggtgcaagaggttttccgaccctcatcctcgtcaacgaagaaaataaaggagttaaaatcacgggtggtcgaccattagacgtctatattgatggattaaagcaagctttaaacacagaagagcttcaaccgaagaagctcccagtggtttctgccttactcgaaaaagaaaaatgtctattctctaaagagattgaagtgatgtacgatgttgatcaatcggatgtgcggtcttttatggagaaagaactttcacaagtaccgtttcatatgaaagaagctctaggagaacagtatttcacaacttcaacataaggagaatggcgatggcttacgtattacaagtggattttaagatgaatggccctttcggagatgaattggcaaaagagttttctgatttagcgagaagtattaatgaagaggatgggttcatatggaagatatggacggagaatcctgagaaaaatgaggctggcggaatttatttatttgaaacaaaagaagaagctcaaacatatctcgatatgcattctaaaagaatcactagcttcggcataacagacatcaatgcgaaaatctttgacataaattctgagctgactcatatcacaaaaggtccattaaaaacgcattaagattaacacaagaaaaaagagcggttgttgactgctcttttttcttatgaatgaagtaagatattcaactttaaaccgattcattaaaaggttatgatcagcagtttcccctagctcacttgctgcttgtttttttaattaattctacaccatcatatgatagggtttctacatgtgtagccttttgcaggatgtaatgatcaaaaaacgtcttcgtatagtccgtcacaagatgatgcatctctaatgtatcccttgtgcctttaagttcctcatctacaccggtaaacacgatgtcacagtaatctaaatgtgcagcaccatcaacagagaaataataggtttccatgctgttgttagctccaatgattgcattcatatcataattcggttcagaaaacagcagcaaaaaaggtttgttgaggtcactgtcgagaaggccgaatgcaccactatctaagccaaccccgcaggcaaaccggtcgtcatcccggcaaacaaaagccgctgtaggtccgccataagaatgtccggcgatacccatgccgatgccgagcagcagtctgttatgaaagatggacttcgattctccagagtctagtttgtgaagataatcggctgcgtactttacatcttcagcctgttgttcactatatcttgttaactcgttaatgattggtaaggaaaggacgttacggcacatctcaatagccgtttcatcgtcagaacgcatcttcatcttaccagctagcgtcatcatctctggatcttcagaaaacgccataatgacattcgaaaaatcctttgatacattcaacagctgcccatctttgcgtttatacatggtgctattctgatggccgatactgacgacaacatatcccatgcttgctaggtctgagcagagtactgtcccccattctggtgaaccgcccccgccgcaaacataaaatagtactggatagcgctctttcttccgagaaagagccacatcgtcataacaatgcgtttttatatcgatagagaagaagtttattttcttcaaatactcagtgacaagcggctggtcatgaagcatttcgtagacttcaggaaacatgtacgtggatggagtctttccttcgctgctatcagatggatagtacataaatgcggtcagttctcttttcgaatgatctgatgccgtatactcaaaatccatctggattcggccggctatatagctacccattggttttgggaatgtgtcataccttttcattcttttatgcccctttcatcttgaaaatggatatctgttctttgctgggtgagtatcgttttgtgatataatctggagtcaaagacaagtgctaagagaaatgaaatgaacttgctgaatggaattcttgattgtgaaacattctgaagaaatgatagggtgatagcgatgagaagacttgagtctggtatatcaatagacaacgaaatgttttctgatgttgccaggtatgaaaacgaaacaatcagtagaacgacaatcatcaactcaaatgttcgttctcctatattttggagctgtcacctgcatcatcttgtatttgatacgtgtgatctcacgaatgcgagattttttgctggtactacgattgatgattgtacttttagtcgttcagacttgcgctctgtgggcattgccaaaaacgaagctgtcttcaccaattgtgtgttttcttcttgtgatatgagaggaatgacattggagaatgctatgtttatcgattgtactttctctaaatgtagattcaatgaccgcgtattacaggcagcgaatatcgtcaattgtacctttgctggtaagctaatagatataacgtttgagggaaatggcaaacaaaagctgatcgccaattttgaaaactgcacccttgacggtgttcgttttacaggctgtgacctagcggcatgtattccgccagcatccaaaaatcatctgtatgttgaaaatgtatcttcacgtgtgaaaaaggctttggagaagatagatgatgatcctactctttctgacgatgatcgtaaaatactagtgcgcagtctgcgcaagcttgaaccaatggaacagtatatgtttaacacgaaacatatggagaaaatatatggggctgcttttgttgagcgatttttcagtcatcttggatgcagcaagggcttactaccatatttcttctatcgtcttcatctgaataagggtgtctcactgcaacaattgtatcaaaatcctttatccatccgataaagcgctgccaatcgtaatggcttctggatagatctaaagttttcatgaaaacaaaaaattatgtttacacatatcatcttcttatctatttttatagcgatgaatcatatagcagatcatttttgtgatgacagaggtacacatgcatagaaaagtcatagcgatcacccaatacatattcgatatgtcaaaccccgtataggcaaagataaaaacggttgaagctgcaaaggtgattattagaacgatgtagacccgcttaaagatgatatagcctacaatcccccatattaaaaataacaaaggcaatgtaaataagatcagagccataggttgaagaaaagaaacactcatcattcactctcctttactaaccagccatttttcaccccaatgaaaaagcgaacaatcattatattaatgggaaatacgctcattgtaaacaaaaattggaatttaatgaagcggaatctgtattgaatggacattgtgattgtatttaaaaagactgcttaagggaagcagtctttttggcgtgaacggaatccctaacgattgatcacctgaataattttcttctgagcatcttgtgcctcggggattggcatgacaacaaacacatgcaacatttcaggataaacaaaggttttgatgtccattccttgttctgttaggttttcatcgagctttatggcatctggatataacatatcatgtgttccaatgaaatgagtaatcttcgcaactcctttgaagtcaccgtaaatgggactaatcaatgggtcagttacatgttgatcagctgtccaaatctttgcaatgacttccattccttcatgacctagaatcgggtccttttttgcatattcaaacatgagaggattgcttaagctcatgtcgacacatgcagataataaaataatatccttcggctgtggcagattcttcttctttaaaaggtgcgccagaccaagtgagatgtttccaccagctgaatctcccatgatcgtcaattgattggcacttccggcagttttcagaaggtctttatataggttaagaattttcggatacgtatcctgatagctataatgaggcacttttggataaataggagcgaccactttcgcacctagtgattgcgccattttatccatgaaccaccagtggacattcaaaggctgatttgtccatgcaccgccatgtagatagagaatgactttttggttttgtgatgcttgttcatttaatgtgaaaacttgcatgccttcgaatgtttgctcttgtacctcactcattaacttcacatcatctccaatggcataaggctgcgtattttcaattcccttttgctcaagaaatttttttgtgtgttcgatactagaaaaactctctttattactttgcgaagcgaataatgtttcaaattgaatactttcttcagaacgttcaccatgataaatttctacactcatttttttctctcctttcactcaatatgatgattgatcatcctcatttggtacacgaaatgattctaggtagacttgtacttttttttcaggggtctgtaataagttagataaaaggtcttgaatgagacgaaggcttttaattttcttttcaatttcttcatgtttaagatggacaatttctcttagtgtatcaagttctatgtcttgacttagcatgtccataatttcagctatttcctttaatgaataacccagcgttttcgcatctttgatcaattgaatcttcacaacatagtcttctgtgtagaatctgtaaccgtttgaacgtcgtcttggagcaggtaatatgttgtgctcttcatagtaacgaattgcggcaggacttactcctgtttttttggcaagttctcctctagtcatcaactccatcgttactccttttttattattttgtcttactatatgtacattataaaggttgaactatacttcaaggtcaaggcgaaacattcattttatgttaggggaaaaatgacgaagccacaggatcagagagatgaacaaagtcaacgtttttttctaatagattaaattgaaataccttgtttgtattttatttttcattgatcattctactgtttaacatttttaaggttgctgtaaggttcggattaatacaagttaaggttggggttgtacaatgggtttgtaaggaagtgagggatgagtcaaatggtcccctcttctaaatcaatcatagaggtgaaaaggtttgagagaaaataaaattttgtcttcattatgttacttcagtatcttttttgcaccgtttctgtttccgattatcgtttacttcttaggaaaggatgaagtgaagtatcatgcgaaaaagtcactatggacgcatgttattccttatttgattttcggtattgggattgccggttcaggtttacttggcatgaacgatatcagtcatgctggtccgttcttaattgcaacgtatgctgtgacattccttgtggcgatctacttcttcatttggaacattgtgaaaggcattaaagtgttttcagaataatagatgaaaaaacggttctgtgattgagcagaaccgtttctttgtatgtccgttcaagcgggtaattggatatcaatcgttgtgccttcccctatcatactttgtatcgtaatatctccgccgtgtttttggatgatatcttttgcaatcgccattccaagaccagagcctgcatgtgtccctcctgtattcgtccctcgatagtagcggtcaaacactttttctagctctgcctcttcaattcctttgccgctgtcttgaattgtgatgtgggtatgttctttttgttcaaggtgtacaatgattttcacatcagcatcattgtgaacaagggcatttaaaatgagattggtgaccgctcttcgtatgaggatcgtatcaatattcagcataagcttgtctacattcgtttgcagctcaatggtttgatctgcatatctagaatcgttgaggatatcaattaacgtttcacgcagcaatggcacaatgttcaccagttctttatgcagcatcacatcgttatttttcagccttgttgttaaatttagatcctccatgacatctttgatgtacagtgatttattctctatgatgctggcataatgtttgatgtcttgatctgaaagaggataattcggatctttcatgatttctgcatagccttgaatagaggataatggtgttttaatatcatgagaaatatgactgatccactcttcccgcatttgctctaatttgtctttttctttttgacttgaagcgagctgctctgataagtgattgacattatagaaaacatctttatatatccccttagttggcagcttcgtcgtataatctccgtttgcgagccgctggatgccataaatggcacggccgagcggtttgatgagctgacggctgaataagtatccaatgaataaggcaatgatggcatcaatcgataataaaatcatcgtcccgatattgaattgcgctattaagtctttcgtatcaaaagaaaataaatattttccgatggaagggtccttaaatccgataaagtagctgtattccttgccctttccatttttccccccagcatagatcgtcgacatcaattgcttatctttatatttgtgtaagtttacgatttctataggtgtgtatttgctttttaagcctttaggtgcttgtgcatgataaacatcttgtccattttcgtctaatatctgaatccatgcattttgttgttttaaggcttgctgtccttctttactcacagtgatatcttgatcggacaaggtgatgtattgttcaaatgttcttgtgaaggtttcgggcgtattttcttcgttttgctggctacttgcttgtagtacaagccaaatcatgaatccaaataagttaataaagaccgtgataatggtcacgataatgacagagaccatatatctgcctgttaatcgccatttcatctttatgcatcctttacaacaaatttatagccaagtcctttaaccgtcacgagaaattctggtgtagatggggaattttctattttctctcgaagtcttcgtatatgaaccatcaccgtattatcagaaccgaagaaatcctctccccaaaccgtttgataaagcgtttctttactgatcacgcgattcgggtgctgcaaaaaataggtcatcaacataagttctttcggagtgagctcaatcgccgctccgtttttcgtcagttccgcttgctgctcgtttaactcaaatggcccttttttgatgatgggatctggttgagaaggctgtaagtatgacgaccgtctaagctgggcttttacccgataggcgacttcttttggactgaacggctttgtaatataatcatcaccgccaatggcaagtcctacaattttgtctgattcctctccctttgctgataaaaagataatcggaacatgcgagacgtctctgatttgtttgcaaatatcgtagccttcaccatctggcagcataatatccagtatgacgagatcgggttgttcttgatggaattgcgagagcccatcacgggcagttgaagctgttatcacccgatcaatgccttctcttgttaatacggtatggattaattctaagatttctttttcgtcatctataatcaagactttgctttgaagttttggcattatgatcactctcctgaagtcattgttattattatacccaaagtggagacgtcgtgaaaaatcaactttctatttacacagaaaaaagccaattttcttttttaatgagaaaattggcttttgttgttttttagcgtttgaccacaaatgttgtcacactttgagctgggagatgtgcccaaaattgatttcctgatatgtttaagtcagttccaggctgaaggttactgttgctgctcgtgatccatcttgacgcttgtgaagcagttccgttttgaataacaaagtgttgattgactcctgcattgtttttgttaatcgcgacaatgacgacctgattgtttcctttataggctgagacgaaaacattcggttcagggcttttcgttgcatcaattctgacgaaccctggacgcacaaacttggagaaatgcgccatgttgtatccacgcttgctaatcattccatcttctttcataggaccgtatgatctccggatgtaccaccatacatacgcttgaaagtccccttccaccattgaatggtgaatatgctctgatacccctaatgcctctggccagcggtccgctgaattgttatcactattcgggtagtagacctctgtcatccacagctcttttccccctcctttttgtttgaaaagaggatacggaagctggctgatttgggttccgtacaaatgggcaccgagaatgtccatattactaagcgcctgcggatcgtttaagataggatctgagatatttttaaggtattgaaaagattctggtgcaatcacacgtgcattaatggagccagcattttctctcatgaatcgcaggatttcctgaggtgtccaccatgtccattcatgtgcataatcaggctcgttctgtacagaaatggcatagagattgacgccgttatttttcatgaatgtcacaaaatcattcaaatgctgagcatatgcggcgtattgattgtatctcagccgctttgcagacgcaccattacggttgaaagtctctaccatatggcttggaggattccaaggcgaagcgatcaccaaagcgccgtgctctatcgctcttttggcggtggcgacttctctctgccaattatttctgttctcgtctacataaatccgtaaaatggagaatcctaactgattctgtccattgccaaaggcggaatccctttgagggccggtcaaatcaccaatccaagccgggtggttcattccgccaaagccgcggatcacttgtctttccgcattgacattaatattcgcatctgccgctgacacctcagttaccccaggccctaaaaacatgacagacaacatagtgaagcagaccaataaagtgcaaattggttttttgattatggacatcaaattttcccactctcccatcaaccagttttgtttacctttgagtaaactgccaggaatcaaattggaataggctggaaccatttcctttgaagacaaagaatacgttgtgtactcccgttgccccgttgactgctgtttctatttctcgccagtttccacctgtggaagggacattgagtgttccggcaattctgccgtctggactgccaagacgtacctcaatttgtccgcctgaagcggctgctacattggctttaaaggttctggcacccatcgatccgaaatcgacattactgacggccacccaatcgccgttttgaatgtttgtgacatgctggttattgactggcccaccaggtgctgaggaggcctctgttaaaatgcgtccattccaagcgaacgtttcggcttctacccgctgataaggatttaggttggaaagctgtttaacgccttcaaaattggctgcgacctctcgaagggagccgtcagcattatgcacaagcttattaatgtgtggagatctgtagcctttccctgctccgtataaggcagagctcaccgtttgtgtgtgatacacgacataccactcgtttttaaaattaaacacagcatgatggttgttaccgccgccaccgaaaaatgaacccggatttttcaagaagtgtcctttatacgtaaagggacccataggacttgagctcgtcatataaccaatctcgcctggtggtttatctgctgggtgggagccgccaaaattgatgcaataggaatagtaataggtaccgttatacttatgcattcccgaatcttcaaacataaaaggggcatcaatggttgatgcactgccgaccacacttgtcatgtcaggccctagcttcagaactcttgctgttttaggattggcccattgtccctgcgttggatttgaaccgcctggaacgcctcctccggcatataaataaccggtcccgtcatcatctacaaatacggctggatcaaacagccatacaacaccggacatccctggtgtatttggcgtgacgagcgcttttccgataggatctttccaaggaccaatcgggctgtccgctgtcaagacgccaatccctccgccgctgttagcaaaatagaggaaaaatttatccttcccgttgatcttcttcaccgcagcggctggagcccaagaagcgcctgcccatttggcaatccctttcccgccattcgccccattggcacctgctactggaatcgctccgtgatctgtccagttcaccatatccgcggaagagatgacaaaaaccctattcaaatttgcaaaagaattgtccttaatcgttccattgctgtgatactcatagtcatcgctcgacatataaatgtacactcttccgttataggtgagcgcaaacggatccgcccccaggtgatggtctatgagcggatttgcatttcctactcgttttgcaatgggggtacttgctgcactcgcatcatatacaggtacacagcttagtaccaaagcaaaaatcaataaacctaaaccgcacttcatcctctttctcatcgtgtcattttcctcctgttttcaacttcctaatattggggtttacgcccaatttcaaattatgttgatagacgctgatgaagaatgaatacaaaggatgatttcttgggcgaatcgctgctaaaacaacgatgaaaacccttactttttgactaggagacaacaaaaaaatgcagttctccttttagaactgcatttttttagcttattcatgattgttgatcacatataacgcgcggtcaccattttctttcttgtgtaaaactctactccgtctgttccattggcgtgcaagtccccgtagaaagaatccttccagccggaaaacgggaaaaatgccattggtgcgggaacaccgatattgacgccgagcatccctgcttcgatgttttcgcggaattctctgatgcttgatgcactgtctgtgtaaaggcaggcaccgtttgcaaattttgattgattggacaggtcgatcgcttctgtcagtgaagagacacgaacaattgataagactggggcgaaaatctcgtcctgccaaattttcatttgatttgtcacatggtcaaagatcgttggtccaacgaaatacccttttccatttgtttcatgatctttcctgccatctcgaatgagacttgcgccttcttcaatccctgactgaatgtattgaagcgttcgctccttatgtttctctcgaatgactggacctagaaagacctcttcatttattccgtttccaatgacgagctcgttcgattcatcaactaatttttgaatgagctcatctgccacttcttcttccacagcgacaacggccgcggccatgcagcgctctcctgctgatccaaaggcagcaccaatgatttgttttgttgccgcgtctaaatctgcatctttgaggacaatggagtgattttttgctcctgcaagtgcttggacacgtttgccatgctctgtgccttttttatagacgtattctgcgactggttgagagccgacaaatgaaatggctttaaccttttggtgttcaagcagaccattgacaacatcgtgagccccattgacaatgttgagaacaccttttggaagacctgcttcttcaaatagttcggctaaacgtgcggcaagaatcggcgtgcgctctgaaggttttaaaacaaacgtatttccgcaggcaatggcaagcggaaacatccagcaagggaccatcatcggaaagttaaatggtgtaatccccccgatgacgcctattggatagcggtacatgccagattcgagtccagatgcgatatctggtaattgttttcccatcattaaggttggtgcaccagcggcaaattcgacacattcaatccctcgctgcacttctccttttgcttctgttatgctttttccgttttcaagcgttacgagttcagccagctcatcccatttttcaacgagtaactgctgatatttaaataaaatgcgggcacggcggggaacgggagttttcgaccaagtggtaaatgcttcttgtgctgcctgtaccgcacgttcgacatctttttttgttgaaagcggcacttctgcgatgacctcgccagtagctgggttatatactgcctctgtttgactagtttctgcctcaatccattgtccaccaatataatttttcaacatttgtacatctgttttggtcatgttccctctctcctttttatgaaaaaatgtcatgcttataggatgtgtttggttgtcattgtctcatcaaatgggcgcccatcagtatacactctttgtcaaatattattgtcgttttggtttacgttgtgataaaagcttgctctaacgtgtgaaaggttgccgcccatccctttggttgtgagaaatgattctcgaatgcgattcattcatggtgattttttggttaactcttgattaaatttacaaaaatcataatattaaaaacgctttcagtcaatcctctttttgcagcataaaaaaacctgatgcgcgttgcatcaggtagaggctggtttatttctgttaattggttgatgcggtatattgattcggttctgaaaaatgcgggagcatctcaccatgtgcttcaatgagttcatcgcataatttgatgatgtcatcaatcgatagttcagcgcttgtgtgtggatcaagtaatgccgcttgataaatgtgctcttttttgccgctgattgctgcttcaattgtcatgagctgtgagctgatattggtccggttgagtccagccaattgttcagggatttctccgacatagcatggcatgatgccgctccgatctgcaacacacggcacttcgacacacgctttttcaggcaggttgtgaatgaggccgcctgtgttcagcacattcccagcaaatttaaagggaacgttcgtttcaatcgcttcaatgatacgagaaccatattcttttgagcgagtatgtgtgatcagtgtattgcccacaaggtcatgcttcatggtattccagttgttaatttgctcctcgcagcgtctcgggtattcatcaagtggaatattaaattgaccgatcaattctggatagcgcgatttgataaaataagggtggtattcggcgttgtgctctgaggactcagtgacatagtagccgaatttatccatcagctcaaaacgtaccatatcatgatgccgtaatttctgcttttctttcgctcttcttttgatgtctgggtacaaatcttttccgtcccttttcacttctaataaccacgccatatgattgatgccggcaattttttcttcaatgccttcatgatccatttcaagtgattcaaatagatcctttgtacacacctgcacgctatgacaaagacccaccgtttgaacctgtgtataacgcagcatcgcacctgtcagtgtggccattggatttgtgtaatttaacaataaagcatttgggcaaacctcttccatctcctttgcaaaatcaagcatcacaggaattgttcgaaggaagcggaagatgccgccgatgccaaccgtatctgcaatcgtttgtcttaatccatatttttttggaatctcaaaatcaatcaccgtgcttggccggtagcctccaacctggatggcattgattacatattttgcatccattaaggcttcctttcggttgtgataggacttaatggtcacatgtgcaccgtagttctcttttaaatagcggagcatcgtttctgattctttcagccgcttatggtcgatatcatataaagcgaattcaaaaccgcttagtgcagggacgaacaaacaatctcctaatatatttttagcaaatacggtactccctgcaccgataaatgtaattttagacatagacgactctccttttaacatcaaatatgtggaactaccctttgacagagccttgtgaaagccctgcgataaaatatttttgcaacagtaaaaacatcgtcaccattggcagcatcgcaatgagcgcagcggcaccaacgagctggagctgatgttgattttgaccaaaaaaatgggatagggcgactgtgagtgtatgcatctctttatcttgcaaaaagaagatggcaaattgatagtcgttccaaatatacacacaggcaatgattaaaacagaagcggtaataggtttcagaagcggaaaaacgacggtgaaaaaaactctaaatgtccccgctccatcaatacgggctgcttcttcaagctcctttggaatggtcgaccggataaagcctgcgtataagaaaatggttagcggtaaaaaagcagcgacattatttaaaatagcgatttgataggtgttcatcatcccgatctgaacgaccattttatagagcgggacaagggctgtgagtggtggaatgaccataatggcgatgaataaaacataaactgctttattcagttttgtgtttcttcttgcgagcggataggctgcaagagaaccaagaaagataaggcatacagcagagctgaacgtaatgatcacggtattcaaaaaggattggccaagctgagcctctgtccatgccgtgcgaaagttttcaagatgaagcacttttggaaacagccattttgaactgaaatctcctatcccctttaatgatgtcgtcaccaagatataaaatggaatgagatgaagcaatgtcaccaaaagggcgaggaaggagtaccatctcttcttacgtttaaaagcattttccatcacacctcggtctcctttcgtttgaaatacatcagtgctgcgacactaatgacaaggatgatgaccgccatgaagaccccttgcgttgctgcatagcctgcatcctgacgtttgaaatacagatcatacataaaggtcgacattgattgtgaggaatctcccggtccgccgccagtaagcgccacaatgacatcaaagagcttgagcccgccaatgacattcagcacaacattaatggtaatagacggtataaggagtggcaatgtgattcgcctgaattgctggaggctggatgcgccgtctaattgtgcggcttcataataatccttaggaatgctttgcagtcctgctaaataaatgatcatcgcaatcccgacgaattgataggtgttgacgagcacaatgatccatgtgtttaattgcggattgccgagtgcattcatttgatcaaatccaaaaagcgccaccacatcgtttaaggcaccgccttggtaagcaaacacaaaataccaaatatagcccatcgcaatcggactaatcatgacaggtaaatagacaactgttcttgtgatcgctctcatctttaagctttgatttaataaaagagcatatccaagtccaatgatattttgtaagatggtgctcccgattccgtatagaagcgtatttttaacaacaagccatgtcgctgggtcctgaagcagacgtttatattgatcaagcccaatccattcataagtttgtgaaaacccattccaattcgtaaaagatagctgaatgccgttcaaaaaaggataaatgataaaggtactgacaacgagaacagcaggcaagtacatccaacaaagggatgaattttggctttttttcattttctgctttggtaaagaggtgaatgcggctggctgctgagtttttgtgatgtcattcattggcttcactcctgtttcagcatgcgcctgctattgttttttcagacgcttatattcctcttccatcttcttcgataattgttctggtgtgatggagcctgctaataattcttgacccgatgttgccatgactgcccacatgccgcttggtaagtattttcgatcgaaatacggttcaatcttcacctcttcgtattgatcgtaaaacgtagaataatagttttttgcttttacttgctttaaggctgcttcggatgaggtgccttctgcgatttttttcgcattttcaggctttgcgagaaaatcaatgaattgttttgcttcttttaaatgtttggagtctttccatgcagcgaccgtaaaccgttctcctccaatccagctttgtttatctccttcatgaatagatggaactggcatcgtgcctactttgatcgatggattgagttcagatgcttcaggtcctaaagagcctccgacaaaggtgaaggctattttgttttgtgacatcagttcaggtgcttgagatagttttgctgtgaggacatctttgtttaaaagatcttgatctttcaagtcctttatgaactgtgcaagcggtgtatagagagaccaatcaaatgatccgttctcaagttcttttccgtagcgatggtttggaccggtgatcaacaaaggtgtggcgagttcatcaaagacttgggcgatatttgagttgtctcctcctggtatccaaagcggcacaacctctcctttgctcttttccttcactgtcagcaaagccgattggaattcatcaagtgttctaggtacctcaatgtcatagtcctttaatagattggcattaaagctaagcccgtcttttgcttgattcagcggatatgcgtatactttgccatcttgatcctttaaaatctgatcgagtgaaggatcaagttgtttcacccaattcatctcttttagatcagcgacatactcgctatagcgaagtttggcccagccgtgtgtgtcaaacagatccggcatatcgtttgcccccatttttacacgaatcgtatcttcatagctgttgcctgggaagttggcatcgattcgaagatgtggatgctctttttcaaactcacgaatcacttcttcaaacgcttttctttccccgctgttgctcatcgtcgaaaagagagtcaaggtgacctttccgtttgcttcagacgtaccgttattgctgcaagcagacaaaaaaatggtcaagacaaaggccgcagtgagcagcatgatttttttattcatggtttcctccttttgatcactgaaaattcagacgataatcggtagaattcatgcagttgcggaaacaaaagaagtccattatactggaattctattcttttcaaagagataagagagcataccggtaggctgccttgttcttcgcatgatctagccatcatgcgaagcagcttgctttctgcttttttgtctcttttttgtttgctgaaatctcgggttcaccccctttcatggatgaggcatgtgctgcctctttcgatgagtttggttggcacgacgacttttagaggaagctttctgccgtttattctctcaagcaaaagcttcaaaccgacttcccccatttcttctgtatatactttgacggttgtaagtggcgggcttgaaaatgaagctgcttcaatgtcattaaacccaacaatggatacatctaaaggaacacgcagaccggcttcgttgagcgcgcgcattgcaccgatcgccattgaatcacttccgataaaaaaggcttgtggcaggtttccttttgttatggcttgtttcatgagcatatagccttcttgcatggagtattccccaatatggatgtcatccagatgaagaccacctgcttcttgcattctcttcataaacgtcgtttgtctttcgtcctcaatcacagcattcccttcgaaataatgttcacgctcctttccgccaatatagcctagatgtgtatagccaatcgattgcaaatggcgaattgctcgatctgccgctctgacaaaatcaacatgtacacaatcatacaaatcctcatccgcataatgattgataaaaacaatgtgttccattcgattagtcattttttcaaccgtatcaggactgattcgtccaatgacgatcaaaccgtcaatatcttttagcatcgcacctttatccatgcttctcaggcgaaaggtatggagggtggacagcccttgtttggcatattctttttcaattccttttcgaatcgatgaaaaaaagggatcatttaattcttcgtcaatggattgagcgactacgataccgatgactggggattcagatgggcttttttcctctgcttgatcggcttttcttgctctcacgggggtatagtttaacttctttgcaatgtcgaggatgttttgtcttgttgcgtgagaaacggcaagggtttgatcgccatttaacacacgggatacagtagaaacggacacttttgcatcatgagcaatatctttgagtgtggtcataggcaaactcctcttggtttttgactaaatatttactaaagataattgaaggataccacgttggtaaagcgctttcaagtgtggatttgtgatttttaattttatttttgagcatgttttggttggatgcaaaagtttagtaaaattgcgtaaaaaaagaggattgtttcatcctcttttactcacgtgattcaattgaggctgtttcttttgaaaacaattgcttcattgtctcccaagccgtgtcgagttgctggtgaaggccgaataaacctgagtttccgataatatagatctcgtttcccgcctcagcaagctgccggaacgtgtgctcattacaagagccgtctacttcaattgaaaatgagtatcctctcttctcttttacctctttcacctgtttaattttctgaagcatctctttaataaaaggctgacctgcaaaacctggatcaatcgtcatgatcgtcactcggtctattaaatgtagataggaatctaatgcttcaattggtgtggccggatttaagacaaatccgacctcacagtctctttgatggatatgccgaatgatcctaaaaacgtctctttgcacgacctctgggtgtaagcagatcatgcttgcccctgcatcaatgcaggcatcgattaaaaattcttggggggattctgccataagatgcacatcaatgggtcgatctgttagttttcgaagctgttctatgaaaaagggtgataaggtgatatttttcacgtaatgaccatccatgacatcgacatgatatcgatctgcccttgtgttgagaatatgaatatgttcgcggaagtgcgttaaatccatacacatcagtgaaggtgaaaaaatggctgtcattctcagaagcctcctttttacagttgaaataaaagcttgatcaatccaattaagattccgatgataccaaagtctgtatctccaaaagttgtcccttcaaaaccaagggttcctaacacaggtaataaacaagcgggtaaaaaggaaagaagcaatccattcacaaaggccccagcgacagcccctctcacgcctccagttgcattaccatacactcctgctgtagcgccgcaaaaaaagtgcgggacaagaccaggaacgatgacagttaaaccaaacaaaggtaaaagaaaaatagatacaatgcctcctgcaaaactgcataaaaaaccgataatgactgcatttggagcaaatggaaaaacggttggtgcatcaagtgccggttttgcccctttcacaaaacgatcggcaattcctttgaaagcaggcacaatttcaccgattgccatccgtaccccggctaaaataatgtacacaccagcagcaaaggttatcgcctgaatgagaataaagacagcgaagttcgtgcccccactcatttgttctataaagggaatcccagcaaacggtgcaatcgcaaagaacagcaaagccatcgtgattgaaatggccacagatgtatctcgtagaaagccgagtgatttaggcacttgaatggtttctgttgatctctctggacgaccgatccattttccgatcattcccgctgtaaaataaccgaaggtactgaagtgtccaagcgcaagatcatcgcttccagtgactttccttgtgaatggctgaagaatagcgggtgcaatgaccatagcggttcctaatataatcgaaccggtggtgacaagaaacgctcctttcattccacctgtcgagagaacgactgcgagcattgcagccatatacaaggtatggtgtcctgttaaaaaaacgtatttaaagggcgtgaattttgccaataacaaattgaccagcatgccaaaaatcataatgagagctgtctgtgttccgaattccttttgagcaatggctgccatggcatctgtatttggcacaactccttgaatgtgaaatgctgcttcaaacatttttcggaaaacgccaagtgaatcagacacgaccgtggcgcctgctcctaatattacaaaacccatggttgtttttaatgtgcctgacacggtatctgcggctgattttttctgcaaaagtaaaccggccagcgcaaacaaaccgatgagaattgccggtgtacccaatatatcgttcatgatcagttccatcatgatgtgaatcccccctttttcgtggcttatatgtgtttgcgaaggacgtctttaatggcttcctggtctaacaagttatttaatccagcgacctttcttgtgccgtcatccagctgatcgataatgtctgttgctccgatatatagatcagcttgttcatttttacttgtgctgagatcagtatggtccacttcagctgcaagtcctaactcttccaatgcttttttgacattcatttccacgatgaagctgcttcctaatccgtttccgcatacaacaagaatttttttcattctctatttactcctttatcgttgtgaaaattgatcaattagtttttgcaccgatgctaattcctttgcttcaaccagttctttccttcgcttttcatcacttaacagcatagtcagctgtttgagtgcttttaggtgggtcatactgtcaatggctgctagcacgatgatgagacgaacctgttttttttcatccttagagaaaaaaacgggccgttcgaaagacatgagtgacatgcttaattcgttcacgccgtcctctggtctggcatgtggaatggctacttgtggtgcaatcacaatataaggtccattttggtcaacggactgaatcatggcatccacataacctttctgaatggcattttgatcgagtaaaggctgcgctgcttttgtgatggcctcttgccatgtttctgctgtttgttggagatgaatggttttttctgttaataaatcgtttaacactggtttccaccctttctgatgggatacatatgcgggatgaagcaactttttaagatcacgaagcagtgctttttcattttttacgatggtatgctcttgaatgatgttgaataaagcgttcacattgttcttatcaaacatggtttcggcactttctccatattgaagcaaggtttttttctcataggcagtaaggatgggatgaacgagatgaactggctttcctttaaacgaaataggtgttgttgacacaacaaagtcgacatcaatcgatgacagttgttcatatgagcgctttgataatagatcacgtacttcgatataaccgattaattcgataagctgtgttttcagcatgtgacttgtgccaattccttcgccgcaaacaatgtatacagaacgccgcacaattggcgaaatcccttctcttctcatccaaccaccaaaatgcatcgccacgtaagcaatttcatgatcacttatcttggagcaggtcgccttttctaaatgacatacgaccttttgagtgatatcaaacacctctggctgtgtttttttaatagattctgttaattcattgttgatatcaatgtgatagatgagtctgtaataggcagggatgagatgcatggttaagttttgctccaaggcttcgtactcttgaaaggagatacatgcataccgctgaaaatcaaaaatcatttgtctggcaatggtgcgaatgagatgctcttctggcttttgacttgatggaagcttttgtttcttggcgctgagccatagagtgctaagaaaatagatttcatcatcatgaacttgaagacccgtttctttttgaattcgtgccatgaaacgaatagccgccaagcattcctcagtttcctgcaatgtacgcttttcttcgtttgaaaggtgtatagcacgtcctagcttcatccgcttaaagtagaaaaagagatccaaagacagctgatccagcatgtcatcagcaaactcgagctgaagctcttgttctgactgctcgaggagatattttaacctgttatatgaaataggcccctttaaccaaaaagaaggaaatgctttttcgttttttatcatggtgcgaatggaatgaatataaggtttcagtgccaatcgaatcgctctttcttctcctgaaatcaaatagccgaaggctgcctgatagtgaagcgtgagctgctgctttgaaagtgcttcttttagctgtttcatatcttcaagcaatgtattccggctcactttggtgagcttcataaaatcatcaatttttagacatttctcactgcatgcaatggataagagcagaatagcccttctttccactaaacatggttcataatcatctccaacgagaatgctgttcgctttttgaataatgacttctttttcatgtgggtgtaagtagtagccaagttgatcttttcgctgaacgtcactaagctgatggatttccagccagctattcatgcgtttgatttcagagtagacggttcgagtagagacattcagtcgattctgtaaatcttcaattgataaataagatgtcgtgtgaatcagcattgatagtaaagtcgtgcctcttttggttaagtgcagttggaattcctcccttcttctctttggttataagtctaatcaactcacatgcgtcaaagaagtccaaatgttttcagtaaatgctgtgcaggtttttgggtgctcttttgttataagaaaaagcacactcgtatgagtgtgctttgagacttgtataaaaagaaccctttttctgcttttatatgatagaaaacgattgtcatgaggtcatggatgtactgggaattttgaatgaccttttaagatttaaaaataagaaatacccaatattgccttgctatgtgatcagcttccgaatgccccattgagcaatttcaaccgcctcttgactcaatagattgtcgatagcggctctggcatttttcaattcagttaagttagcagctgaaaactttcggtcagcttttgcaacttcttcaggtggatcagtttggatccccgctaagtcatcagtaagcaaaatctcttgtgtaatttccacaaagtcttgcagtgctgcccttaccttttcaggatcagtctccaagtctccatcgtcgtaagaatcccatttaaataaaacagaattcaaggcatcttgtgccgcccaaaactcacgacgcatgcggcctttgtcatatctgttctttacttctccttttgataaaaagaagtttttgagcaaagaaaaaagccccttctcatcagaagctggcttgtgatcctcttgttttcctatgtctgctgttccggccattgaatatccggtgatctcacccttttgaatctgttcccaaatttcatcggaagccttcgtcacaaggacccacgatcctttcttgataatctcctcgcccatttcaaagtcagccggtgcaatgtacgattcaacgacttccccgacaccgccttggaaatcatgctgcttgtcgatctcacgtgcatccttcaggaacccatgagcggctttttcgatttcttctggtgtcatgtaatccccatgtgcatccgcaacgtttggttcataaacaataccgtacacaagacgctgcgcatcatcagctttcgcaatgaccttgatctctttttgaaagtctggctgcttttccgatttcataaaaaagaactgcttttgattagcagccttgtctacatatgaaacgtgtgtgatttttgcgttaatcaattcgcgtggcaattcattcacctcctttcagaggatttctaaatgcatagtaaatatttcgctagcatctaggaacctattagcttgagattcagatatttcgtcataaccagataatattccaaacaattcttgcagattaataaatgagtctctcaatttcaaatcaataatattgttttcatagagcacatcaattaaatctcttgcatcatgataagacaattcaatatcgtttttatcacatatttcaactatcttcttgtgatataacgccatgctaacaccacaggaaaccgaggaccttttatggcaatttctctcttattgctttaaaatcatttctcagtggttctaaattaaccatttccacatcaatgttattaggtatcgcattagaagtaacctcattcagttttttatcaatcaattcaagttcaaaatctttgtattttatctttgctatgtttttaataagatcagtaataggtgttttcagcataatcactacaataataatcgagataggccatatcattgctgtaaaaatagttataaacccattaaacatagaagatattaattcataaacattcataatttcccctcattctcaaagtaatgaggatattatactattttattccatgttctgtaatactcttcttctaatctcttctttttcctcagctgacaacccaagaataacaggctcaaccacaggaccaaccgcacaatgacaatttactcgctcttttggcgtgagctgtgtatctcttggaaacatgcaccgctctccgctgcccggtatctgaaattcctcatcgagtggaatgatcgtgccgtcaagctgcacatgacattctctggactgattctttttcccgccgcagtgcttccattgctttgccgttacagctggagattgtacatatgattcatgttgagcgacggaagaagcggtcaacacttctgtgatagctatcacacgtgcgcgcttccggctgaattcaggaaggtctttcagctccagttcaatctcctggatagagcggccttcttttataccctctttcaatgtttgctcaatggctgtatgagtattcagctgatcgtctttagatataaaacctccattaacaccaaaaaccttgaaaggtattaagccattcaaggtttttttgtataatctcattaaaaatcaactaatttgaattcatttttgaaaggaaatcttgaagaactaactttactggtgaattcgcagtagtagtcaacacttgatttgcacgttctaaaatttgaggatgctccaatatcaattttttgccttcctcaattggaaaacttctcaatgtatcaatacagatctcaaatagttctttatcattaatattcaacaaatccattaaaatatttaactcatattcattgcactcattatctagacagtacgcaattttccgctgccactctattggcttattgcgtacctgatttgataattcttcccaatcgttcaagctaaaatccgagagaatctcactagcaatcaaacacccgtcgtcataccacgaatctaccgttgtatcagcagataaaagattatctaattccttaaacacatcaatacctccatttaaattaaaatcctgatgggcgtaaagcattttctgtacctgtcggatacccgctagttacatctttccccactttaatcacatcaatttctacaccatcaatacgtgctctatgccaagttgctctatctcttaatcttgatgaaatagctgctgtatctccaacgtcggtaatacttttgagaattttctcatccttccaagaatcaggaaagagcgtgctttttttaatcttagagatatttccatcagaaaactgttttgtaaatacaacattttttgtaccatccacatttgttgataatacttcaactgcaaatttttcattatcattattaattctaggcgaatggccacctattaactgatttttgggaaccttccgttgtccttctagaatcttagcttcaatttctggactaattacagttcttctagcagaatctccacctgcaccctgaattcccatctttccatgaaaccctttcgctccaaacggcaaaagcattccaagcgccgcattcatactcgcctcctgctgttctttcgagatcttattcccgaacatatctctaccagtaattgcttcgctgaagccattggtggcggtgaggccatataagcctttttgagatgtttttaaggcgtcaaaggatttttgcgatgtcttgtagatgtcgactgctcgtactgcggctgaagtggcttgagagatcaccgaaattagaaacaccttgtagtgctttttttaaatctaccatttgttcgcggagttcctggtagtgttttgctcttgcgtccatagcacttgttagtgcttttgcatcaagtatcttgcccagaagaagtcactccctccattattgatcataaagtctattttacctttctcatcgaattggaaaaataggctttaagttacaaaaataattttcggatattttaatagagatgaaggcaagtgacaattgaaatgattttcctaatcatcacaaaaaaagtcagccttcttttcagaagaccgactaccttttgtttagaaaaagcgtttgaggcttttcttgagtggagggatatccagctcacctttttcaaagaattttttcaataaatatttactgaagcctgctgcttgggtgtaagtaattttcccaggtaacggaggttcattgtctacagcgacatcaataatgactggcttatcggattgaagggctgtatcaaaggctggggctaattcttcatgtgatgacacggagattcctttgccgccacatgcctctgcaaacttagcaaaatcaatatcctccagctctataccataattcatgtttccttttacctgttgttcatattcaatcattcctagattgttgttgtttaaaatcacgacaacgatcgggagcttatattttacagctgtcacaaagtcttgcatgaccattgtgaagcctccatcaccacatacggcaatggcttgtcgattcggttcattcaatttagctgaaattgcaccaggtaaaccgcatcccattgtggcaagccagctggagataatgaaatcctgctgtttcatttcaaaatgacgtgccatccataccgtcacattacctacatcaactgaaagaatagcgtcggcctcgactgcttcttctagtctagcaatgacttgctgtggtttaatcggtgaagtagcaacagatttttctttatccatttcttctcgccacttcatcatatgctctgtacaagcttcaagaaaaccacgctgctctttatattcaatgtaggaagtcagttcatgcaaaccactcttgctgtcgctcacgattcccacatctactggatatcttttaccgatttgatctggtttaatatccagttgaatggctggcgtgtcttctggtaagtagtctctatatggaaaggaggtaccaagcataattaagagatcacattcttccatcgcttcatatgccggcttcgttccaatttgacctagattacctagaaagtatggatgcctgtctggcacaaccccttttgcagggagtgtgatgacgataggagccgctgccttttctgcaaatgaaagaagctcttcttttgcatgtcttaatcctttacctgctaagatgaccggcttcttcgcattattaattagctgagctgcttttagcagttgatctttcttcggccgtacttctccctccacataaagaggggatgtataaacaggtttacgctttattttttgagaaaataagtcatccgatacggtgagaactgccacacctttatgggtataagctgctttgatggcttgattcaataagtcaggcagcgcctctgctgtctgtacctgctgattaaaaacagcgacatcgtcaaacatccgctccaatttgatttcttggaatgtatctctgcctacttcggctgaagcaacctgccctgcaattgctaaaactggtgcaccatctgcttttgcatcatacagtccatttaataagtggacagcacccggtccagcgatagataagcagacaccgagtttacctgttagtttcgcatcagctgccgctgaaagtgctgccacttcttcatgtctcgtttggataaattttatttggcttgattcatgcctaagttcttcaatcaattcgtttatgctgtcaccgggcattccataaatatgtttcacgccccactcttccagtagtgctgttacttcttttcctgcggttctttgcggcatgtgagaaaactccttttttcttactccataccaccgcatccttttgatcaaacgtttcaacttgctcctgctactttttaaaatgataaggcagggttgccaccacaatatcccgcttccataataggcggaatcttaataaaaaggcagattgattatgcaaaatggtgtgccatctttttttcggaataaattgaggcacaagcaccatcactttatattgatgcgcatttgcttttgcctcaatcgtttcaagaaatttatcaagcgggtgaatgaggcttcggtaagacgagtgcaacatcacaagtcgtacaccgctatttagtttttcccaatcctcttcaattttcttatccttttctttatcaaaggatacatgaaccgctatgacttgctctgacaaagactttgcatattgaacagattgttcgacaacacgcgtcacacccgctataggtacgatgaccacatttcctttaatctcaacaggctctgtttcattcattaaacgcaattgttccccaacagacaggtaatgctttttaatggaatggaagataaatagaacaataggcaggaaaacaaatactggccatacgagatggaacttggtcaaaatgagaatcatgaaaactgtaaaggaaatcagtgctccgacgatattgattggcattttcgttttccatccctgcggtttttcacgaatcaactttacacacatgccggtctgcgacagggtaaatggtataaacacaccgacagcatatagcgggataagatgttctgtttttccatcaaacaaccagatgagcagcatagaggctacgcctagaaagataatgccgttagagtaaccaagccggtctcctcttacagtaaacatacgcggcatatacttatcctttgctaaattcacagccaataacggaaaggctgaaaagccggtatttgccgctaatattaggattagcgctgtgactgcctgaatgacgtaatagaaaaacgttcgtccaaaagtgtctgatgcaatttgtgatacaaccgtttcttctggctttggcgaaatgccgaaaccaaacgcaagcaatgtgactcccacaaataaaacagctagtaatccacccatcatcaataatgttcttgctgcattttgagcagccggttttttaaaggatggaatggtatttgaaatggcttctactccagtcagagcagaacagccagatgaaaaagcttttaataaaagaaataatgtaatgccttgtacgtgtgtgcctactgctgtatgctcaggtgctggcggtacgccacctgttaataatttaaagccgcctactccaattaagataaggagtgaaaatacaaacaagtatacaggataagccagaatagatgccgattctgtcaacccacgaagattgagcaccataatcacaatgaccaacacaattgagatcaagacatgatatggatatagtgctggaaaagctgatgtgatggcatcagtaccagctgatatgctcaccgctacagtcaaaatatagtctacaagcaatgatccaccagcgatcaatcctggtttttcacctaggtttctgctagagacgacatatgccccgccgccttctggataagcataaatgatctggcggtaagatagaattaacgccattaaaagaattaatacacaacctgcaatcgggagtgagtaccaaaatgctgctgcactaacgacagaaagaacaattaagatttgttctgtaccatatgcaactgatgacaatgcgtctgatgacaataatgccaacgctttgatttttgatagtttttgttctcctgctgcctgtgattttaatggtttaccaattaaaatacgcttcatcaaactgtacatgtgatgcccgctcctttagtgtcaaacgatttaagttgcaaaagatggatcgccaaaaagacacagaggcaatagaatgcccctgtgcctattctttagatcacaggttggtctttgctctctttaacgcttacgaggttagctgacggattcgggcgcatgagactttgccctacctaaaaaggattcaccccacgtggtgcttcacaccacaattggttcccccgctcatcgaaatgattcagcgattggtcttttataaaagagatcatactcccgtttgacaccaaagtaaagagattttttcgaggtcttttgaccgtttattaatcagtctttttgcggttttttcgtacgaaataaacaatcatcacaacgacaaaaatgatcagtacagcgatacatgcaaaataaatccaagactcaccgccgccttgcttttcaccttttttcatatcattttttgcattgctgactgtttggttgttagagaacatatctttgttcttgctttctattgcaactgtagcggtctccgtatttgtttgaaggaatcgaatcacttcatttgatatatcagcgtcagctgccgtcattcctgaaaaaacggtcatggtttgttctttattccatacagatggctgcgtccatacaatacgagctgttgtttcgttgatcatgccaaatgaggatacatcatattgaccctttttcgctggaacgatgagatcgtctgctttttcttttaaaagagagaatgtgtggatgcccccgaagaaaatcagagagttctttttcaattgttcatctgtcacattcgatgcttcgaccaaatgatagtgagcagcttccggttgactaaatgattcggtcagcaatgccatttgattgattgatgcttgagtgatttgatctggcataatgatcaatgtgtttccttgctgcgtttccgaagtgtaagggagcggccatgcggctaagtcgggtgtatcagtagttgttccttctggtatttgaagagagctgttcttatcaatgtaaatccagccttcttcatccgtatgtctacaagattccatgtttttaaaacctgttgtgacaaactgtaagtccacatattcattcttttgaagtacttgtgaatctactggaatcgacacatgatagaatccattctcatctttgtttcctagttttgttaacggtacgtcgtacggttcgttattgatcatcactgttagacgttccgctttgttcgctggatctgattttttaaatgatagatttagttttgcacctgatttttgttgagccattaatgctttcggataatagtaatgatcagatgctgtctttttggttccaactctgacatcatctgcgccaaaatctattaaacgaatatgatgagatggcttagaagcactagctgtcaccttttgcagcagcaagtcggttccagtgagctgacctatcagttctggctgagtcaaaacattgattttttcagcaattgtctttggctgctcagcagtgacaaataaaatgggttgttcttttttctttgctgtcagggttctcaccgctaacgtcagttgatcgccttctgttttaattccagccgcttgctcgatcgatttcattcgtccattccagcttccttttgctcccacagcaatggttggatgtgcaatttgctcgacgtccttttcttgaacgagtttgaggtctgctaggcggtctttgtttttcaacgtacgatatactttcatggccgcttctaattcagccgcttctggtctatttggaatcacaatatctgtttgttcttcctgatcacttgatggaataaatggtgaaggaaagctgtctaacgtcacgtctttcgtttgaactcctttgaacgccagctcactttcaggatatactttcagccaattggcaggcgtctcttgattgatacacacaccttcttttaacacaccataaaatgcgagttgaatttgatgagatccttttttcaattgcgctttattcaatttgatttgtatcgatttttttgcgttttttcctgatacagggatcgttttttcaatctctccatcgatcatcactgtgaaagacgatggcgatatgagtaatggtgaagcctctatatttaatgtaagagtgctagactctactttttctttctccatttgataggaaaattcagtgcggtcttcttgaccatacaaggttaccacatcttctgatagatgctgcgtttctgtttgattcccttttgatgagtgaacccaatcgtctttcacttgtactcgattggattgcgccattgcttgacttgccatgaaaaaaggctgaatggcaagggatagcactaatataaaaaacatccatttgaccgatttcaatttgtcacccgcttttcttttgttgttgatcgtaacgctctgttttgtaccatttcacttcttgtttcaataatcggctcttcacctctacacataaggagtacacgacaagcgcaatccatacttgagaataagtgaagtacatgagaaccactatgagaatattttgtttagtgagctctgttttctcaatacttaatgtaatcatcacttctgttagaaagaggaagaaggctaatccccaaaggatcagtgcgacagcccctacagataagtgaaggtcaacaaataggtttacaataaagatgccatttgagagcagaacaccgaagaaaaataagaaatacgtaaagaagaaataaaacaaatcaaaaatcattcgttttcgtttcagcttcataaactgtcttaaaaatttaagaacaacatattgattccctctagcccagcgcgttctttgccgccaccagaccttccatgtctcaggctcttgctcccatgtgatcgcagctgggaaaaatcgaatcacatagccaaggttatacacacggatcgttaattcggtgtcctcggccaaagcttggacatcccacccgccgagctcttctaaaatgtgccggcggatggcgaagttggtacctggtattgtcgcaatcccaaaccatttccatctcccgccctgcgccatccattgaaaacagatggtctcaatattaataaatttggtcagcaaatttttggctgcattgatcaccctgaatttcccgacaacagcgcctgcttttgcgtcatttaataatccaagaaccaaatgatagacagcctttggttcaggcatgttatctgcatcgtatacgcaaatcacttctcctgttgaagccttcaagccttcattcagtgcagtggatttccctttccctgcaaatggcggcttcgtttcaatcatatgaacatgatcatattgctcactaaatgattgcacaatctctcctgtgcgatcagaggaattgtcattaatcacaatgatttcaaggaggtgtttaggataagatagctgaaccatcgcttttaatgtctgccgaatgacgacctcttcattatgagcaggaatcagaatactaactgtcggcagatccttcccttgtttcgtccatttaggcagcactttttcataggtcaggtaatgctgaaagccgccctgcataagaaacatgtggtataggagcatgatccaaataagcattaatgaaagataaaataagacatcagccacctaattttctctccttaaaaattcgttttttcattgtcagtcttaaatacaatgtgtataaagcaaatgccgcaataaacagcatgaccacgaccgtgagaattctcagcacattttccataccacttcgtttgacagtttttgtttcggcgatgttggattgctctacttgaatatgtccattcccggatgtttgaattttgacatgtgcagtttggaccgtctgttttgttttctttatatccagccaatcgctagaagggattgcctccatctgtgtgattacatcctgtaaccctgctatccccaactccacgtcataggacagccccattgcggctgattgcagatgctgcacggattgaatcgtctgttctgttaaaacatttgaacttttttggtcagacgcttgctcaaattgccgctgaggatataaggtcatgccgtgtaacatggcaggagacgtcacgagcggggatgcaccgactgatttccaagtgcggtctgacagctgcacctgtccaaatagactggacacatgctttgaaataacttcatacccttgttgagatatcgcatcatgcggcacctcgaacccaagaggatataagccttgactagcaagaagctcaatgccctttgtcagtttttcttctgtataggcgatttcttgctgctgatacgatttggtatacgtataaaagtctttttcatttgggaattggcttttactttgtttcttctcagcatttttgggttcatttgtcgtgatgggctgatcatattttgcatcccagaactcaaatccctgaccagattcctccgttcgatacgtacggctaaagccatgaagaataatactcgctccattttcttgcaattgttttaaaacactcacaagtttcgggcggtcactcagtgtgacttcatcacctgttgcccgatttatccaagcaggggtcactgcaatctgataaggaatatgctgtgcggatacgtattgtccaagttcaagcagctttttctcgtcacttgctggactgatgttcccgagcattaagtattttgtcgtcatttgcacagaagatggcatgtatttttctagcacttctgcaagaagctcgttgtgctgcacaacatctaagataccgatatatgccgcaccttcttttgtttgagtcacaaatggttgatcagattgacgtttcttcactagaaattcatttttcaagtctgcccctcgaaccgttaacacattgatacttctctctaactgacgatatgtctgatcatgtgtatgtttcacttgactgatatgatcttgtttctgaaaagtaagcttagagaatgggcgaagctgttccgcattgtatccaatggcgatgaattgctgtgattcgttcatcgcacgaatcgtttgttttgacaaggttctctttatttcaccaagataaatgatttgctgaaattcattaaccctcttttcagccaaatattcatcagatacaatcgtcgtctgttttgaaaaatgaccggcgagtagatccagcatatgaacggccggagtcacttcccccgatggtgtagaataaacgatcagtgtatttggctgcgtgacaagcgcatcggctgaagcaatgtgtttaaacgaaagaatcgaaaaaagcgtgatcatcaaacaacatttcatcaaagaattaaagttcattcatcatcatctctttttctagttcttctaaaaactgctctggcgaacgataatccgagctgcttgttaaatgacagacatgaaatgtcaagatcacttcacgaccatttaataggacatgtgtttgcagtttaacctttagcttttcaagaacaactgacacattttcttctggtgtatgagttagcagcaagcctattcgttcttcagatagccgaaatttcttatcggtttctcttacgctttcgcggatcttgagacttaattgctgaaataggtgctgcatttctttttctccatataacgatttgaattccgctgcgtaattcatatgaagaaggataaagacaaatggctgtttgtaccgttctgcccgtttcatttcctcggataattcgagcttcatccgctcagcattgtcaaatcctgttgtcgagtcaatcgccacaaattgtttgatggcctgcttttgttgttcaatggtgtgacgcagcgtattgatccgttcatgcaagcttcccgctgaaacagcgaaaaaaagaagtgctacgccccaaatcactacatcttgcaatgtttgatttgaaaaaagagcattttcatgaccaagctctgtaaagaacatggcgcttcctataaagaacaaaatcagcaaggtgaagattaatgctggtaggataccaaataaaataccgcagcctaacacgacaaatgtcagtgcgatgatcataaagctctccgcatcttgtacgttgaggtagcccataaacaaaataaggcctgcaaacgtgaggagcagagaatagtacaagcgatacgtgttactgaacaaccgattcatttaaaagctccctttctgcaattagaggcaataagttatcaaacgagtgagtctctttttcgttcatgtatcctccgtaataaggctttagaggatcttgggtttgtaattctttcatacggtgatagaccgtctttgcgaatttcagctcgttttgtttaagggcatacaaaatgacgagtgcatataccgaaggcgattcatatgtgacagatggctgcaatgtgctcagcttatatctcccgtacagttttccttcttgtttaaacgacgttttcagccatttcatgatcgcggacgtattcacctttgcatggtatgcatgtaaagctgtataaagttgatcgatcatattaatttcttgatcgaatgaataggtttttttctttatgtcataggacttaggaaagaatcctttttttctcggtgcttgttttagaatggctaattggttactggtcatttgtttcgtgaatatgtggagggattccaattctttgattgcttttgggtctatataagagagagtgattgtgtgcgaagttcgatttgttgatgcatcataataatcggacaatatgcctttgaacatgtttttttcttttaacgcttgagcgatttcttttgctgtcgtttgatacgctgactttttccacaaacgatttgccttttgaagtgccgtcactacacgtaaatcatcaactaaagcattagccttacttttttgttcagattcaatttgccagctgagaagacgatggtctagtaaaaattgatcttgtagaacatccaactgttggtcaaataaattttgatctttttttcgaacaagataatccatccaaagcccaagtgattcagataagtaaatatgctcctctgcaaaggaggtacgaatcaacccttgatctgtcattaagtggtgagtgataaaatattcaccaggtaaaacgggctgtggtgatactggatcagctgattctttctgctgcctccaggtacatccgcctagtagaatgacaatgactaaaacaattgctgtacgatatatgcgtgtatgcattcgtgtcccctttcaactcaccgttctctaaacatctaacgatttattatagagcgtttttgcttaaatttaaataaatattttataccaaattacgagtcttttcgcatattcattcccattttcagaaaaacagcatgtcaatatacttgataatactgaaaaacccatgcgtttctgcatgggtttttatagaactattgatctaattttaatttctttaattgttcagctagtgcgttattaattggttcttccactttcttttgtttcttcatatatttagacacatcgtgcttactggctttcttttgattggattgagatttgcgtttttcgaagacagacagcttttctctatggccgcatacacaagcaaagattttaccatcaccttctccgcgcagttcgagctttttatgacagttcgggcagcgtgcatttgttttctttgccacatttttacgatggccgcattctcggtcctgacagacgagcatcgtgccatgttttccattcactttcagcatgagtttaccgcagtctggacaatgggtgccagtgacattgtcatgcttaaaggtttggttcgtctgtttgatttcagatacggcttgtttggcatacgatttcatttcactcatgaattgagaagctttcaattgccctttggcgattttagaaagcttttgttcccattccgctgttaatgcaggtgactttaggtcttcaggcactaacgagagcagctgcttccctttcgaggtgataaaaatgtctttgccttttttctcgattaagaagctattgaacagcttttcaataatatccgctcttgttgctactgtccctagaccacctgtttcaccaagggttttcactaagtccttttcctcgttctgcataaatgccgctgggttttccatagcagataatagggtcgcttcattaaaacgtgcaggaggcttcgtttctcctcttgtttctttcagctgtcgtacgtctagtgactgtccttctgaaagcagcggcaaatgttgatctgcctcggctgattcctcttcttcatatgaatcatcgtacacggctttccaaccagcagcttgcacggttttcccttttgctgtgaacgtttcactgcctattttggtgatcaccgttgtttcctcatactcaaaaggattcatgagtacagcaaggaatcgtttggcaatgaggtcatataatttacgctctttatcgcttaatactcctgggtacagctcttcctcggttggaataatcgcatggtgatctgacactttggcatcattgacgaagcctttgtgcgctttcacacctgattgtaaaatccggttcacatgctgcgtgtacggtctgacgttcattccttttaaacgatcttttaatgtaggaacgatatccgctgaaataaatcgtgaatctgtacgtggatatgtgacaagcttatgctgctcatacaatcgctgaagcgtagataatgtttctttggctgagaagccatagcgtttatgtgcatcacgctgcaattcagtcagatcgtacagtcccggcgcgaaagcttttttcgctgtttttttcaacgcatcaaccactgctggttttccttcgcaggctgccaagcgctctttgatcacactctcttggaatgtccggttttgctttgttttggcatcctgccatgtcaaagtcagtccatctacttgtgcagtcaatccatagaacggctttggctgaaattgttgaatgtcttcttctcgtttggcgatcatggcgatcgttggtgtttgcacccgtccgcaggaaagctgtgcattgaacttcgttgtcagcgctcttgttgcgttgatgccgacaatccagtctgcctctgcacgtgcaacggctgagcgatacaagttatcgtattctttgccgtcttttaaacgtttgaagccttcttgaatggctttgtccgtgacagatgagatccatagtcgtttcaaaggctttttcacatgcgctttttcaagaatccatcgtgcaacaagctccccttcacgtccagcatctgttgcgatgacaatgtctttgacatcttttctcgcaagctgcgctttcactgcttggaattgttttcctgtctttttcatcaccacaagcttaagcggttcgggaatgatgggtaaatcctctaaacgccaggattgaaactcttttccgtagccttcaggatcagccagtgtgaccaaatggccaagcgcccatgtcacaatgtattgatctccttctaaaaagccatttccttttttatgacacttcagcacacgtgcaagatcacgtccaaccgaaggtttctctgctaatacaactgtttttgacactagatttcacatctctttcttctatccatccttttattatagcagacgtgaagatgcggttctaatgacggattatttcttcaatcgtttgatgatttcattcgtgacttcttgcgtttgataggcgccgccgatgtctgctgttaaaaagccatctgctgtgactgattcgatggtttcgagtagatgggtgcccagttcttcctctccgaaatgatccagcatcaatttagcggtccagatttgaccaatcgggttggcaattccttttccagcaatgtctggagctgagccgtgtacaggttcaaacatggatgggtatttgccatttacattgatgttggcggcaggcgctacgccaatacttcccataatggctgccccaaggtctgtcaaaatatcaccaaacaaattactggcaacaatcacatcgaatttttctggtcttgttacaaagaaggctgagagcgcgtcaatgtgctgtgagtctgctgtcacctctggataatcctttgctacgtcttgaaacacttcatcccaaaaaggcatggtatgaacgatcccattcgatttcgttgcactcgtcacatgctttcgccttttttctgctaattgaaaggcaaaacgcatcgcacgctctgtcccttttcttgagaacactgcattttgaacagcaagctgatcttctccttgataaatacggcctccaatttcactatattcaccttcaccgttttctctgacaactagaagatcgaaatcctttggctgagcaagcggtgagcgaatgccgctcagctgttttgcaggtctgacgtttatcacttgctcaaattcccgcctaatcttaataagcagtccccaaagtgatacgtgatccggcactaaattggcatctccgacagcccctaagaaaatgctgtcaaaggctttcaattgatgtaatccatcctttggcagcatctcgccatgctctaaataatattcacagctccacggaaaatcctgaaaggtaaaagacagaccgccatgtacttctgataccgctttcagaactcgtatcgcttcaggtacaacttccttcccaaccccgtcacctggtatcgccgcaattgaaacatgcttcattcatttctccccctttattgtcggtcgaccgtcgaccgtttaaatttgagtttactagagagtacaagttctttcaatggataaaggcgcttttttaatcaaagcgcctgtttatcctgcaaaagcaacgagggtttctccttcttccccctcgcaccttttttatctgaaagcagcagtccgcctaaggtcagtgccgttccgagtgctgacatgagggtcaatctctcatgaagaacgatcattgaaataaccatcgtaataataggaacgccataaatatacacactcgctttcaccacaccgagcgttttcactgaaaagctccatgtgagaaaacaaatggcagatgcgaacaggcctaaaaacaataagtgaaaggcaaacgacggcgtcgtcaatcgctcccagtctatacgaatcttaaaatgccaaattaggggaagcatccagagcaagccgtaaaaaaagacacgtctcgtcacttgaatgatatggtatccatattggttaatgattttcgataaaatagaatagaaggcccagacaatggtcgccgttaatgctagcgcatcaccgattggattcaattggaacgtcgtcattccattaaagctaatcagtacaattcctgtcatcgcgatgaaaaagcctataaaaaaccggcgatgcaaaggctcatctttcaataaaaaataagccaataaaaatgagaagaatggtacaactgagctgatgacacctgcattcgaagcgaacgtataggtgagtgcgacattttctaaaaaatagtataagaccacaccacataaccctgcgagcgcaaacatcgcttcatgctttttacgttgcaccttcatggtgatcggatagatcaacatcagagcgagatatccaataaaaaaccggaaaaataatatttctgttggtgaaaaagccgttaacaatattttggttgagataaaggtcgatccccatagaaaaatggtgaatatggccgctagatgaccaagaagctggttatttttcatctgctgttacctgctttgcaaaaatgtactgatattgccctggtgtgagcccaataaattctgaaaaaaaatgactcaaatgactttgatcagaaaaaccggcggagactgccgcatctacaggcttcactcctcgcgagagaagctccttcgcataattcactctcactgtctgtaaataacgatacggtgtgatccctctgtactttgtaaaagctcgcagaagagagtatttgttcatggacactagctctcctaagtcgtctaacgatatattttccgtaaggtgtgtttcaatatattgctgtacgtcttggactttctgttcggcagcatgcgctgctgatgctttttcctctgatgtatcagcgtaggcttcaatcagctgcttcataaagaaataaaacgtttcctgtttattcaaagctggggcttcttctgtaatcatttgatgaagatcatataatgactttgtcagttcactttgtgaaaacacaggggctttaaaatgtggtttgtactgaaatatcttctctattatatctgcttctatatttaaacagcgataatctaatgtcctgtgatccatctgctcgcatgcgtgattgtcatatggattaaaaagaaggatgtctcccttttcaatgatgtattcttcattttggcaaatcaaacgtctttgaccatcttcaataaatccaatcacatagtatgtatgaaaatgattcgggaacttttgcatgatgccatgaaagcgatacgcctctatttgcaagtcctgatcaaaatgtaccgttcgttcttcttgtgttttcatgtcgatcccctctttcactgaactgatcattagtgtagcacaccctttttctcttgcattgtacgatattgacttttccgatgtaggcttgcctagagggaaaaacttggataacatgagacaaaagatgatgtgtaaatgagggaaggacaggatgaattcattcgagatggaaagaccagcaccataccatatgcaattttatgaacagctgaagcaaatgatttttgatggacagtttcagccaggcgaacgcatcaatgaaacacagcttgccaaacaatttggtgtaagccgatcaccggtgagagaggcgatgaggcttttagaaaaagatgagctcttgatcgctgaccatcggtcgggctactctgtttatacgttaacggaaaaagatgtcgaggagctttatcaaattcggatcgccctagaaacacttgctgtagagcttgcatgcaaagaggccacgccaagagagctggatgaaattgagcaggtcctcacgcaggcagacgaagcaatcaaacagcagctgccatctaaagacatcgttcagctacatgaagcctttcatcaaaaaatcattctagcgagccacaatcaccgcttatataaacaattgaatcatgtgaatgcactcattcatttttgccgtatctttcattttagcggcggggcgcgcgctgagacgattcaaacagagcatgctgccatttattctgaaatgaaagagcgccgctccacagaagccgttcaagcgatgacggatcatttgttacatgatgtgatgcacttaaagcaagtactctctgaaacaaacaaggattaagtgatttttcctttttcccattttttaagcattacatgaacatattttgaatttttcgtagatttcagcatgtcccgacgatctttcgtttatattagaagatgagaaactagcttttatacaggaggatttgtatatgcatacaagtattagccgtcttcgacaggcgggttttattgagggtatgtctcttttgacccttcttttaattgccatgcctctgaaatattttgcggatattccgatggcagtcaccattgtaggctctcttcatggcgcattgtttgtcatctatatgcttattttggcatatgtgacctttaaagttcgctggcatttgaaatggtcgatcgctggtttttttgcggctttcattcctttcggcaacttcgcctatgataaggtgctccgccagtatgatacaaaagcttaatcaaaaagggctaaaacgacattcgttttagccctttttctccttttcagcgtgatagaaaacctttgcagccctaggaaggttggctacttttgcggagcgaatttgacattcgtgagcaccagcacgcaggactgacaccgaatgcgagggtttgtctacacgctgaagtattttttaaatcgatgcatatttcacaatggctgcttgacgtgtcatttcgtgatatgccacccataattcatcacctggcagtacgctagtgatcggatcgattggctgtttcacttcatacatcacgccatctctctcaatctgaatgatcgctaacggctggttgccgatgacaccggaaaatgtgacatgggtcacttttgcacttccttgtttctcttgcataagactgatctctttatccagctcttcttgttttgtctgcatcgtgatttgagttcctggcgcgacctccatatggtcagggatgaattgactgaccgtttttgtgatggattgatctccgctagaaaccgtcacatccagcataataggcttctgatcatgaattgtgactggatattgcttcacccgttggatagttcctgtcaatgtcacgtctttccccgaacgattccgcacttcatgcccataggctgccattttcaactgaccgctgatgtcaacgagatcggctttttctcctgttctaaactcaaaaccagcggcttgaatcatcggaatggtataccttttctgacctgcttcaaatgtaagcgataagacggtgcctcgtcctacggttccatatgattctatgtttcttaaaatagcgcctttgatgaactttggctcgcttggctttgagaagtccccctcttttaagagcatcgcctttttcttcttcggattgtaaagaacgggaatacgctgacccggctgcggtatctgcgtataggatacaaccgttttaaccgtcttctcgatgttttccccatcatattgaaattgcagctgcattttgacaagcggctgttcgttgatgtaggtacccgtttctttgacagatacaatattggcttctaatgtgacactgtccttgatcttattctttctcaccagtctcaaaatcggcggcaggaagatggctagcacaaataacagcagtggaataaacagccaaatcgcccagttgagaatgagcggtccgcctttcatgacatattgcataaaggtgtcaacagacgtttggtgagcaggacttgcgttttcgattgagatgactttttgcaaaggaaattcctttagctgtttgcttttcgtctcaaatgcacccgttaattgattttcgaatgaataatagatccaatcgcttttcacatttttattgaaagagagtccttctctttgtaaagtttcatatgaaaacgactgaaaaagcttggtgacagacgttgtcttattcgtgcgatggttataaatataaccagtcagcttgccttttgcttcgtcctttgctgtagagcctgcaagaagaacttcttcttcattaagctggtagataaaggtttgataaatcggttttggtgttgggacgacttctccaaaccttccctctgcattcactttccttggtctttttggatagttagattcgacagcgactgcgaagttttgggatgttccgatcgttttttccagctgcttctccactttatcttcaatgaggctaaacggttcagcgtttttggtgacatacaccccaagctggttcttatcgtttgagactccgctgacatacgccttctgatcatttttcaaagtcaattcaaatataggaataggcgtctgccctctaaaggaattcatgacgacatcgatggaaacgggtcttgctggcagttttagctcgttgagattgtgcacatgaaactgaccattctttagctcaccaaggaccgcagcggtaccttccatttcccctgtaaacacaagccgcccattccattgatatgtattcgtttttaaaaacgagggtatctgtagattttgcttaacgagctctttcttttccccgctcggcgttagtttctcgatcaacagctgcccctctttattttttaaagcaagtaagaggttgttcccttgaatggatggcagcatttcattaaacgtatcgctttccgtggtccattcactgattctttttcctgattgaggatcatacattccaaaatggagctgctggtcttttgatacagcactcaccactcgtttcccttcatcaaatgtaaatatttgtttgatgtcatattgcgttgctttccctgctgacaaatcaccttggtaatgattccacaccaagacactaagaatgattgctggaataaagaagacaatatacctgaggaaaatcactggtattcttttcacttgatcgcttcctttcatgaggttcctttatcttgtacgttagtgcagcgagaatgtttcatgctagaagaataccattccaactttccaaatccatattttacaaacttggttgtttgcgataaaatccaatcagattcgaaaaaaggatgttatctcaatggataagctatcatcgatcattctagcggcttggctgcgtgttcctcgttggttcaagcaatgggtgcttgtatccatttccattttctttttttatatgtgttttgtaaaggggctgactagctggcacaccttgccgcctgtcactttgctctcatgtgtgattgcttccttcatcatttggctgatgtggcttaaaggtcaaaaaaataaatgaaatggggaaaatcatgaaagaatccatcagttattttgctatctcttttgttctgcaatgggtttggtttggcatcgtgcacccaaataaaggcgtgacactcctagacatgttcatcttttctattttgtttgcggtgatgttcttctttattcggaggatttggcaatatcagaagaaaggccgaagtgagtgatcatgaagcccgccttgttcactgttatcacctgtgcgatcattggcctatttttgatgtcgaagccttttgaagcggacgctatgcgtttggtttctaccttcattttcccttttattgggcttgttggtttcgggttcctattgtttgacccaatgaaaaaggctgccaaatagatggcagccttttctttactcttttcatgcaaataaataatcaatgtttaatctccgttatggagtgtatgaattaagattcgatcatatcagtgtgtcatatgtgttccgaatgaacctacgtttgaaagtaaacgccatggaagttctggataacaagacaacgaaagccctacctctcattcgtccttacggctccgaagccgtgccagtgtgaattgtaaatcaaaacgtcttttttccactcttccgcttttatagggggcgggtgcagaaggaaaagaataagtttgctcgctttgacagcgtctcgttcttatctagtagaagctctattgcttctcattatgtcatagaaaaaagaaagtttactttctttatttatttgcttatttcaacacttaataccatattataacacgttcccccagcttacgcaagtgttaaagtgataattctgctggtgtacgttacgcaagtgttaaagtgataattctgctggtgtacggcttccttcattcatgtaacgaatggaggttggatcaatcttcagaatcactaggttcggatcatcttttcctttaaaccatttctccatttcctcagaccaaaggcggtcgattagatctgaatcgtcggttaatgtggcggtgccttcgatttctgcatacgtatcaccgaatccttcacctgaataaccaatgagaatatggacgttcggatttttttcaatttcatctgctttatgtgtttctttgcttgttggtgtatataatttcagtccctcatgaaaaaaagtcatgtagcgggtatgcggtttatcctgttcaacagtcgccagtgttccgaccttttgttcatctaataggttgagtaccttttgttttaattcttcttgtgacatatcgtttcactccttcaaatttcatccgtattcttaggtttccacgacaatccattcattaaacaaagaaatgtgtttttcataaaaagagagcttctggctgatgctatagaaaacaggctcaatgaagggagaagttgaacatgcatcatgaaacgatgttccatttaagttcacttgtcattgcggcagttgttgtgggcattatcgtatggtctgtctcatctgtgcagaagaatcgcaagaaatactaaagacaccgcccaatcaggtgggcggtgcgctattgatcatgtattcataaaggaaccgccgttgacgtgtagtgtttgtcctgtcatataagacgattcgtcagaagcaagcagtacatagcagccaacatgctctacaggctgtcctggtcttcccattggggtttctgccccgaagctttccacactatcctcatcaaatgtagatggaataagcggcgtccaaattggacctggcgctacaccgttcacccgaattccatctttcacaagcgactgtgccatagaacgcgtaaagccgttaatggccccttttgtcgccgtataatcaatcagcactttgttgcctcgatatgggttaatggaagttgtattaataattgaacttcctggttttaagtaatccagtgctttcttcgtaaaataaaaataagaatagaagttggttctaaaggtttggtgaagctgctcactagaaatatcctgaatccgttctttcgggtgctgttcagccgcattattcactaaaatatctaattgcccaaaggcttcaactgttttttctaccgctttctcgcaaaatgcttcgtcaccgacatctcctgcaatcgttaaacatttgacgccttcctgttctacgcgcttttgcgtatcctttgcatcctcatgttcatttaagtacacaatggcgacgtgtgccccttcttttgcataggcaacagatacagcacgtccaattccactatctccgcctgtaatcaatgcaactttccctttaagcttgccagacccttgatatgattcatcctcaaagatcggcgcagggttcatttccctttcactgcctggctgctgattctgcgtttggcgcggaatgccatttgttaaatattcacgtaaatccatgagtaagctcctccttgatttgttgatgtatcctttcattaccacctcattttttcactcaaacatccctatgcggcacagatgcgttttgaaaatcggcatgtttcaagatggataaaatcggttacatgatcaataaaaaggagcgttctcaaatgctgtcaaccatttcgaaaacctttagcaaaccaaaaggctggctcggaagcatcgcaggcttcattatggcaaaagaaaataaagcgttgaatcagtgggccatccagcacttagatctgacagatggtgaaaacattttggaaatcggctatgggcccggctacagcatcaagcatatgcttaagcattataaagatcttcatatagatgggctagatgcttcatcgaccatgcaggagcaagcacagtcccgcgtcagcaaacggtcaaaggacaaacaagtccggctgtatgtaggtaaaattgagaaaacacgtttgccgggagagcagtatgacaaagtgctgtctgtgaacaactttacgatttgggatgatccaaagactggcctgctcaacctttatcacacgttgaaacccggcggaaagctcgtcattgtgatgcagccaagagaaaaagatgctgatgcgagccggacaaaagagatgggtgaacatatattgaatgatctacagtttgcagggtttgaccatttttctgttgagtatgaggaaattcgtccaacgcttgctgtctgtgtcacagccaaaaagccgagaaacgaataagctctcggctttttttcttaccattttgcttcttttacaaattgatagaacagctgatgcaatttctgttcaatgtcttcctttgatccatgaccataaagtgtcatgctttcctcactttcaatgatagaggaactgatcagactaaacatttctgacccttccttgcctagctcttgcggcgccagcatcatgagcattcgtgacatctgctgctgcccgccgtccatgcttttcacctcgtatgcctgatcaagatcatacatatgaaagattggttccttgatgaatgcatgctttaaatgaaaaagagcaaattctgtaccaggaatccctaagccgccttgctgttcacgttctagtaaaccgcttgctacctcatccgcatgtgtgataaacccttcatcttcaagctgacgaagcagctgcctgattgtagcctcatgctgcggcatcgccattctattttcgatggtaaaatgggacaggatgctgcgaatcacaaacatgtaattcgtcacctgctctgcaaccgccatcatattaacggattcttgtaccggttctttggcagcttctttcatcctttttttctcgatcatgtaagggatctttcgtttaatatgagccttcacacgcatagcatcatcctcgtttaagagcggactgaccatgatgtaatcgatatgctcatatgggatagggacggtcgagacaatcatgtcatagcttgatgcatcgatttcttttagttccatcaaggaagacagatcaaattcggcgatctccggcaattctttttttaaacgagatgcgagcattttcgacgaaccgatgccgcttgagcacacgaccaatgcatgaatgttcgtttcttcttttttgatttcaagcactgagccaaagtgaagcacaataaaggcgatttcatcctctggaaattcgatctctggaaagaaacgctcgactccttcttcaattgccatgaaaagcaaaaagtagtcctttttaatttgttgtgtaagtggattatagattctcatcttttcctttaaacggttcatggcaggttcgagatgagacacgagtccctcatacaatgaatcattctcatttaaatggtagccggttttatttgaaataaaatcaatgagcttcttcgttctaattgcgatatccagctcgatttcatcaatacggtattctgccccaaagctgcggtttgcactgcgcagatggatggtcatatatccaacttctgcttccgggatctcgacattaaacatgcgttcaagcgctcttgcgattcgcagtgatgattcaaattctttcgtccgctttagttcaagcagctcttcctcttccatgcgaatggtttcgccaagctgaatccgttcaatggcataggttaagtgaacgacaagcgcaatataggcgctatcagataaagagagtgacagtctattttttaaatgaaagagcagtctttctaccttaagcagctgccctctgctgacaacgccaaacaccttttccgtcgctttcgttcgatgcttgatattcatttcaattgtttctaaaaataattgaatatcgagccggtcgacaatgaggttgccgacaatctttcgtttcgcttcctccggtccttttaattcaatgccatacccgcgttttcggatcagctgcaaaccgtaaggcgcgatccactccgtcagttcatctaagtcatagctgatggtcgcatttgtgacctgcaaatcggcagcgagtgtatataatttcaccggttcctttgcttcaagcagcgcacataggattaagagcttccgttcgtcagagctatattcaatttgatcctcatttgacatatgagcaagaagccgctgtttatcctcctgttcaccgactgccttcaagcctttccccggctgtttatctagtgaaaggtcataattctttaatatgggtttaatcgattttagttctctatgaatcgttcttgtactcacctgaacagaatcggctatctcacgaatggtgacataacgattttgctggatgatgtatttgatgatcttctgttctcttgccgttatgtacatgaaatgcctccttctgcaaaaataggtctattgtcacaccttaatataaaacgctttcaacaaacgatgcaatcttaagttgatctgactttggcacatcagctgtgacaaaattaaatacaacatctgatcatacatttctccaaaatgacggtccataatccttttgatgaaattgaaccttctgttcatgaaaaggcagtgaacccccagcttttaaagaatacgtcggattgtatactggagagccaaagcaataatccatcgttccttcttccgggcgaaagatgacggttcgcattgttccaaacagctcctcataattgtgcacagctagaccatcaggatattctgtctgaaacagcttagtaagagaatcacttgatcgtcgttgttctaaagcctccagtaacatgtcgtatctgacaacagaatgatgtttcgtcattccttttgccgtttgatcagcaagcggatggtttgtggctgcaatataacctgcctccggtcttctcactattttcaggccatcaatgatttcaatcacagccgcttctccttttcgatcggcaagcataaggtgaacattagaggcaacaggcatttcctgaatagagaaaatggcttcctcaaccgttctacaggtttccagaacagaccgtatcacatgatacacttgcaagccggcaactgccggaggctttaaacctggttcatttccaaccggcggaccacatgcagagaatgtgacagaaagaccatgctcattcatcccatcagatctgccaaacaagagcagcgacgagcctgtatgatatgccaagccctccacatgtgtcgtcacaagacgcatatcttcaaatatcggggaaaaatcatagtttcgcagcatgatcgtttcttgacctgcccccatatttccctgcctcacacagtgggaacagcctggctttagatgagatgaatagtaaaaggtcaaataacgctcatccaattgcagttcatcacaaaatccagcaatctcttcttctaactggggaagatatgggcgcatcagctgcttcgtttctttcacagcctctttttcaagcggttctgttcgaatgtattgtgtctgtagcccttgcttcttcttcatccagacagcctgctgctttcccacttcataagcggttcctgtcatttcttgaaaatatgcactgatttcctccatgcctgaacacctctttcaccttcgtttcttttatcatatcgaaacactccttcatttaaaaggatgaaaaaaactgcaatcccaatggattacagctgtttgcaggattgttgaaacaatgtttttgccattgcttcatatcctttatgatttggatgaaattgatcaatcgataagtactcatgttcatgtccttcaaacgcccggtacacatccacgacctctacatgtggatttgcagcaagcgagcgaagctgatgattgtattgctgaagccaccgcccggctattggtatttgcggaaaaggattatataaattcatgagatatatgcaataggcctgcttctgtccctttttgatctgagcgatttcttgaatcattttgttgaaatttacttggcaatgcagtgtcgcttgcagcagtttcttttcatcttcacccttttcatactgctgaatcgcttgaacaaggtcattcccacaacctgtgatagtgatgatgtcagctgctgcaatagcacgtcttacatcagatcgtttgaacagctgtaaaatctgatccgtcgttaaccctgactttgcaaatacagacagctcgactggtgtatgtgtctttttttcaagcatccactgataccgctctgcgaagcctccgccaaataaacgtgcccccactccaactgttaaggaatctccaatcgcaacataggatcgtcccactcttatccctcactctctcctgccttctcttatatatacgaaatcggagaacagatgcttgtagcagatgacttagagacattcatctttttttcatgagacgtctttacaaactcttcacttgcgagatcggctgattttttgttcaataagaataggtttagatcatgaagtttgcacctgcatgcgttccagaaaaatttacaaactttttatcttgatttcgagactttataccttgacttcaaactacattgtgattacaataaaaatatcagtttttatgtaactgtgcttgttacatctttttcatagcattccaatatgattaaagatgccacatattcagtgtatctttgggatacgctaaaaaaatcactgaaacagaaaggattgaatgaacatggcaaaagttttatacatcactgcacatccgcatgatgaaacagtttcttacagtatggctactgctaaagcatttatcgaatcttataaggaagcaaacccaagtgacgaggttgtacatatcgacttgtacaaagaaaacatccctcacattgatgcagatgtattcgctggctggggcaagctgcaatcaggtgctggcttcgatacactttcagctgaagagcaagcgaaagttgctcgcctaaacgaattaagcgatcaattcgtttctgctgacaaatatgtatttgtttcaccactttggaacttctcattcccaccagttcttaaagcatacatcgactctgttgctgtagctggtaaaacattcaaatacactgagcaaggtcctgttggattattaacagacaaaaaagctctacacatccaagcacgtggcggatactacactgaaggtcctgctgctgaacttgaagcaggccaccgttaccttggtacaattgcgagcttcttcggaattccttctttcgaaggtcttatcgttgaaggtcacaatgctgaacctgcgaaagcagagcaaattaaagcagatgcgatcgaacgtgcaaaagctttaggtaaaactttctaattaactgaacacgaaaagccaatgatcttaacggtcattggctttttatttatctagatgaaagcctaattctctggagataccgctcgcggcttttttgacttgttcaattaagtatggaagacgttccttttgatatcctgcttcaaaccctgcaatgctaatacctgctgtgacttctccaaggtgattgaatataggagctccaaccgcagctgtatagttttcaagctccgaataacttaacgtatagccccgttcatttgattcttccagtatgtttcgaagaacctctttatctgtaatggtcccgattccgattttccctagctcaatcgaatcgatataggcaagtctctcgttctctggcaaaaaggagagaatacttcttgcacaagcacccgcatataaaggagagcgcctgccaacggcggtgtagagacgaacaggctgcgtcccttcaattttatccacgtaaatggcttcgtctccttcacgaacgatgagttgtacagcttctcccacttcatcccgcaagccttccataaatggtcttgcaattctccgaatatcaaggcgttccgccacaagctgaccgtattctagaaacatcaggcctaaccgataaacgcctgaatcttgcttttctaataaccccatatcggttaacgagctcgccatgcggtgcacagacgttttcggcatgcaggaaagctcgatcatttcattcaatgttaattggtcacgtgtgataaacagccgcaaaatctccattgatttcacgacggttttatttgtgttttgcatgtgcatcctcttttctaaacgaaggcttccagcttgattctggcagccagctccttcagttctgcttcttgcttaaatagcgcctgctctgcatcctgatggtcgattcgcttaaaatacaaattcgccccaggcatcgcttgagcaatgagtggcaggtcgaccgtcgcaacttctccaatccgcgggtatccgcctgttgtttgccgatctgccagcagaataatcggctgaccgtcaggaggaatttgaatagaaccaaaggcaaccgcctctgaaatcaattcaagcttttcttttaaatgaaccggctcccccttcaaacggcagcccatacgatctgattgaggcgtgatttgataaggctgctcaaaaaaggtgctttgagatgattcttgaaaaaaagaaaggtgtctccctgacagcacccgaatcacgggcgatttccgcagcggtaaaaaatgcgtatgacttacagtccaatcgggtgcgctgtacgccgcctgttttagattgcttttgagtctatcagacaatcgatccgctacgattgaaggctttccaacggacaggacgtctcctttttcaagcggacgtccgttcagtccaccgattcctgctctcacataggtgcttttgctctccatgaccggctccacatcgaatccacctgccacagcaatgtaagagcggcaccccctcttgcaaggaccaaaggtgatcgtgcttcctgatcgaacaaagagtggtttccataaaggggctggctctccatcaatatcgatctccacatcagcgccagtcactgcaataagctcatccttttgacacgtcagcacagggcccggccccattaatgtgatttccagtacggcttcgttttcctcgttgcctgtgagaatgttggcaattctaagtgagagcgtgtccatgccgccgctcgttaagacgccatacttttgatagcctttccgtcctttatcttgaatggttgtgaacattcctgacttgatgacatggatactcaacgttctgcctccttcatgctgaaaaattccttttcagacatttggacaaatctaacctcgtctcctgctcttaatagacttgggactttttcgtctggacgaaagagtggcagcggggtttgtccgatgagctgccagccgccaggtgtggaaatcgggtatacgccggtctgctttcccgcaatgccgacagatccttttggaatagacattctcggtgtttcccttcgcggggctgcgatcctttcagacagcccgcctaaaaacggaaatcctggtgcaaatccaatcatatagacaagatacgttccgccagtgtgaatacgcacgacttcctctggtgttaaacgattgatccgggcgacttcttctaaatcagggccaagctctcccccatagcagaccggtatgtcgatggtgcggcgctgaatctgatccccctcctgccatttctcttcaaggagtgtttcaatatagcttttcacccattcatagggggataagtctagttgctgaagatgcgccgattgataaacggtatacggctcgtaaaaaacagtcacgtttgtaaaggcttgaacagcttccacatatccgtcaaatggatgctgttcaatacatgaaaacaactgcacaacacgttcatgaatttcttcacatatgtctgttcctgcttgaatcacgattgctgcatctcctagcgggtggaaggtgaaagaatcttttatcgttgaaaatgccacttgaggacccctctctttctaaagcacaccgagctgttgatctcgttgatctgtgatgaacatatgcccaggtgcatgggtaatcgcaatctctggttttgtatgcatgacaatggcttgcggcgtcacaccacatgcccaaaacaccgggacctctccttctttgatgacggatggttctccaaagtccggctgatccacatgagcaattccaatcatcgctgggtcacctatatggatgggaccgccgtgaactgatgggaatctagacgtcacttgtacacttcttgtgatctgatgcgccggaatgggtctcatgctgacgaccattgggccatgaaatacccccgccctttcacaagcgatattcgtttgatacatcggaacgttatgaccgttttcaatatggcgaacagggatatcattcagcatgagcgcatgctcaaacgtaaaactgcagccgatgagaaaggcaaccatatcatcttcccaataagtagagatatctgacacctcttcttgaagaatcccttttctgtaaatacggtatttaggaaagtccgtacgaatatccgcttggggtgctgaccttctcggcactggatcacctggctccagtacatccagcaaggggcatgcagccggattgcgttgacaaaacaacagaaaatcaaaagcaagttcctttttgacgatcattaaattggcttgagcatatccctctgccaggcctgccgtcggtcctgtgatttcttttttacgaatcaactctctaatctgtgaaggctcatatgtttgatagatattcattcgattcagctccatagttttggaatttcattgatgatggtatatccgcccatcattgccatgatgacaacgacaaatgcgcctgatactgtcaaaaagaatggatgtcgataatccccgacaatgtctttcttataagccgctaccagcaaggtgccaagcgcgagcggtaagatcaatgcattgatcgccccaactaatatcaatatgttcacaggtcttccgatcgtaataaaacaaatggtcgagagggcaataaagccgatgataatgccacgttgattttgctcaatttttggtgagaaggttttaaagaaggaaacggatgtatatgctgctccaatgacggacgtaatcgccgctgcccacataatgatcccgaacattttatagccaacatttccagacgctaactggaatactgaagcaggcggattcgctgggtcaatctgtaagccctttgaaaccactcctagcacggctaaaaataaagcgacacgcatcacagatgtaatcaggatgccgaaaacagagctttttgtcacttgaggaagtgcatccttccctttaattccagcatctaatagacgatgtccaccagcaaaaacgatatagccgccaactgtccccccgacaagtgtcacaatcgatagaatatcaatttcttctgggacaaaggttctgagtgccgcttccccaactggcggtgctgttgaaatcgccacataaagcatcaggccgatcatgacaaagcccgctatctgtgtgaaacggtccatcgctttaccagcctctttaatcacaaaaatcagaatggcaatggcagcactgatggctgctccaattcgcggatcaactcctgtgatcacctgaaaaccgagaccagcaccagcaatatttccgatgttaaaggcaagtcctcccatgacaatcaaaacagccagtacatatccgagacccggcagaaccatatttgcaatctcctgccctcgtttctctgacacggcgataatgcgccatacattggtttgcgcaaaaatatctaacaaaatagagatgaaaatgacaaacccaaagctagccgcaagctgctgcgtgaagacagtcgtttgtgttaaaaatcccggtccgatggcggacgtcgccattaaaaaggctgcgcccatcagcatagaccggttcccctttgatgccttcttgtgcttcacttcctgttttttcatgctgtttccccctttgatgacgacttttattgaaaggccttgagatgaatgcttgcttctttaagcttcgatgtaatggttttggcaaattggagcgcatggatgccgtctccgtgtatacagaccgtatctgctttaagcgaaatatcttccccttgaacggtatgaaccttcccttccctcaccatacgaacaaccttcttgactgccagttcatcgtcttcaatgagtgcatgcggttcacggcgcgatgtcagcgtcccgtctttttgataggtccgatcagaaaacacttcatgcgccacttgaagacccattctctcacctgctaacgcaagttcactgcctgaaagcccgtataatacaagacttggatcgacatgatacacagccttcgcaattgattcagataattcagtatttttagccgccatgttgtacagggcgccgtgtggcttgacatgctgcatcgtgccgccttctgcctgaagaaaggctgatagagcgccaatttgatagacgacgagatcataggcttcctctgctgaaatcgccattggacgtctgccaaagccgactaaatcttgcagacccggatgagcaccaatttgcacccctttatccaatgccattctgacggtttttctcatcaccgttggatctcctgcatgaaaaccgcaagcaatgttggctgaggtgacatattctaaaatttgttcatctgaaccgattgtatattggccaaagctttctcccaaatcacagttgatatctacttgatacataggatcccccctttttgttccgaataacggaacttgaagtccgaatattcgaatttatattgattatatcaattttggctagtttgcacatgacattgttagaaaacataacaatagaactaggagaaataaaaaaacgagaggatatcacctctcgtttttttatttatttagacagcacccaatgatggatcgcttttgctacaccgtgttctgtgttaggagctgtaatccaatcagcagcttctttcaccacttcttgcgcatttcccatcgcaatgcctaatccggcttcttggatcatagccatatcatttaggctgtcgccaagtgacatgacattgtccatcgtacagccaatgcgttctgctacctttgcaagagctgccgctttgttaatgccagctgcattaacttcaatattagtcggacttgaatttgtgatttctagatgctcgtttgttttcaatgtattgagtacttcctcacgaacgttatcatcatgaatatcaaagccaaatttcaaccattcatggtcatgaattcgttctgggaattcacctctccacaccttatccacagtggaagcccagtaatcggtttcgtacctattttttagatcccacatcatctggacatgatcaggatgcagcagatctcgttcgatcagctggaagtttgaatcccaaatttcacttccgtttgctgtcacaaggtaagaagacagcttaagcggctccaccagctctcggcatgtcatcagtgtgcgccctgtgctaatcaccacatggaccccttttgcttcagcatctttaatggcttgtttattttcctctggaatgacgtgttcactgtttaacagcgtgccatccatatcaatggcaatcaatcggatgtctttcttatcagcttgtattgacaaattgagtaccccactttgtatcatttttgtttactatctttattttaatataaagaggaagatggcacaaagggacgagtttgatcccatagaaaaaagacctgattgcaggtctctttacataggcttagcgttcacacgcaatgccgtctttatcacggtcaaggtgcttatttttgagataaagcgcttttgatgcatacggcttgtactttgttttgccgcctttgtttttcgtgtttttgctttttgccacgccgcctttatagactttattcagcgatttgcagtttttatacttcactgtctttgcatctgctgtatggctgtcgacttgtgtaaagcttagtaaaagacctaaagacaagacagccaccatgattttttttaacatgtagaatccccctgttttttctatttttacatttttatcatatgtcaccactttttgtttttcaagactattgtgctaaaaaatagatttttttggaataaatcatgctttatatcctatatggtacactgagtgggaaacctttccggttttgacacgtatatgaagagaggagtttttcacatgaaaatgaaatataccattctatatgtaaacgatgttgaggcaagtattcatttttatcaacatgtacttggctttcctatgaaacttagggttgaatcctatgttgagtttgatactggagatgtgaccctatcaattaactcacgtcaggatgtcaaagatgcacttggattgcctgtcccagaagccaatcaatcctctcaaacgttcgagatagggtttgttgtggatgacgtggaacaaaccattgcatcaatgaaggaaaaaggggtttcgattattaaagaacctgcaaaaaaaccatggggtcaaaccgtcgcttatgtcgctgatcctgatggtcatttcattgaaatatgtgatgcggtctcctaatcttctttaaaggagtgaaccagtatgagaaaaaaacatgcctttatcgccggtgtttgctcaatgattgtggttagcagtgccgctattattttgcagcaccatgagtggataggatggatcagtggtggtatctctattatcgggatcatgatgtctgggcttctaatgggggcttggacaagcggagatgaaacaagagccgcctatcattctgaaacgaaagagcaccgcatgtggcgtctggatacggcctttctcatgatgatctttgcacttccgcacatggcagtgtcgatcttttattttttaatgtaaacacttgttaaaaggagttcgtcatatggctgtttttattttattcgttgtatttggcttccctattctttctgtgctgattggcatttttggcacaatgcttttgaagaatgtttggatgccgactttgattgtcctgttagccagcgtcattctcatgtacacatacattggcggggaggaatcctttctcatttgggtcattatctacaccgtctttacgttgatcgctgcatggatgacaaagcggtttcggttcaagtaaaaaagaacagtttgcactgttctttttttgatcaaatatcggcgcaccatagctcaatttcaattttcagctcaggccatcctaaagctgatacataagcaaccgtcattgatgggtaagctgttttgaagatcgtatcccactgaggatatagatgatcccagtcaatttcttccgttgcccatatattgaccttgatgacatgctcttcattcaatccttctgattcaagaatttttttgatattttcaaacgtattggttacctggtcgtttaaacttgatggcacttgtccatcgatatctgttccgacttgacccgatgtaacaaataatcccgcgccctttggtactcgtgtgatatgactatagctgccaacgggcttcggcatactttctgggtttttccttatgattttttccatgtgatttccctcactcactttgatttttctgctagtcttctcttcatgtagacagacttcaccaatttctatctatcctaaaagaaaacagcagtggagtatccatagccacaaggcaagaacatcaatattttctttttcatgaccggaacactcctttcgattgcgtgagcaaggttttgattccttatatagtacctgacaaaagacgttcagtcaaaatggtttatagacgataacgcgcaatatcgtgattcaaccgtatgcttagttcattgagtctttctgctgcttttgccacattggagatggctgtcacctgttcgtctgtggatgcggtaatctcttcgatcgcagcggcattttcttgagaaatatgggctgcgccttgcatggcttttgtgatgaggtcgttttgctccagcaatgcattcagctcttttgccatggcgtctgtttcaacgatggtttgtgaaatcgacgtagagatggcattgaattcatgttctgtcgcatgtaccgcttcatctaactcagcgaaacgatccattgtgtttgacatcatgccggctgttgccgtcgtttcttctttaatgccttgtaccatttgctgaatttgcactgctgattgttttgtctgctcagctaaattccgtacttcactcgccacaaccgagaaacccttgccgtgctctcctgcgcgtgctgcttcaatgctggcattcagcgcaagtaaattcgtctcgtttgaaatgctttcaatcgtatctgtaattttagagatatcctgtacttttgtacttaattgctcaatgcctgctctaatgccttgagatgcttgaatggattgtttatttgattgttttaattgctgaacaatttgctgaccctgctgagaagattgactcgattggtcagagattcgtttaatttggtcactttgttctttgacattctcaatggattgattgaactgggtcatttgttggttcgctacatcaaggtcagatgcctgatgaagtgttccagtcgatatgtcaccaatcgctctgccaatctcttcactgctggctgaggtttcttcagatattgctgataaatctgtcgctgattcgacaagttgactgctcgtttcctgtagaccgctgacaagtgtccggagttctcctgacatatgattaaagccttttgccagctgtccaatctcatctgttgtttcttttaaacttgtgcgttcaagattccccgccgcaatttcttttgaagcagcagtgacttgcttgagcagtctgacctttcctcgagcagctaaataaaagacgccaagactgagaagagcgacacccgctgtaatgagcatgatatagagcttcatctgctctaattctttataaaattcatcctgaaagacggcaatgccgatactccaattccaaggcgtgaactggctcatataggcaagcttttgcttttcttccccagtggcatcatccttatctaaataggtcacatagtgtgcatcctcgccttctgatttggctccagcgaccattttttcacgattggtcgtattatctggaatgacgccaatgtcattgacaggatggacttgagaggaataatctgctccatatgcgacaagatagcctttatttttatagataaaatctgatttttgaaattggtaccctttcccgttgtcatttttgggcccgctcaagtaaatacgggcttgttcctgtgcctgttcaagcgtcagttcttttttctctacacgatcattcaactgttcaagtgtagccattgctccgctgacgatgtgctttagatctgcttttcccgcatcaattaagacatgttttgctaacaaataccccgttgttccaacaagaccgccagttaaaatcgtgatgacgataatggcagacattaattgaaaaaagacacttcttgacgcaaacattttccttttcatatacaaattcccccttacttcatatatcgacaaacggggtaaagtcttaaaaaagtcatcaaaaaacccctttcactcgttggaaagggattttctgattatcgagctgtttctttaagaatggcttgatagagatcgtctgttggcgtgagaccacatacttctttcagcacaccttcaatgcctttttcttttcttaatgcctgcaaacgaaccgcttcttcgtcttcggtaaagtcataagcgagagctgcagcaatgcctttgattaagtacactggctgcttgatctttttcgctggaccgattaaacggtcatctgctcccagctttctaagaggagagcgtgcgacacgagtgacttcgtcggagataaaagcattttcgaatcgcttgatgattttttgaatatacgcatcatgttcttctttttcaaaaccatatgtgtcgattaaataacggcccgtttcgtgaagtgcaccttcaaccacttggcgaatctctgatgtatcgacggcttctttaatcgtttgaacgccttgctgatatccgacataagctgctagcgcatgtcctgtattgacagtaaagagcttgcgctcaatataaggtgtcaaatcttgtacaaaggtcgctccgtcaatctgaggaacgtccccaataaaggcagtctcatcaatgacccactcaaaaaaaggctcgactgatacttttaaaatatcctcatggtgctgaatcggtacaatgcggtccacagcagcgtttggaaaaccaactgtttgtgacagtgctttttgttcctcttctgttagatgagagaaaacggcttcttttaaatgagagctgcccccaatcatattttcacatgccacgatgttgatgatatggtcaggttttttctgttttaatccttcagcaatagatgaagcaatgatcttcaaaacagctggtccaacagctgttgtaatcaaatcggctgatgccacagcctctgttaatgccgctgggtcttgtgcagaattgatcgctgtcactgggccgactacttcttgcttctgacctggtgctgctagttcaaccgtgtattctcctcgtgcattcagctcgttgatgaccgcttcatttacatcggtaaagacaagctcaaagcctgatgcttttaacaaagatccgataaaccctctgccaatattccctgctccaaaatgaagtgccttcatgctagttcacctcgttaaagatggcgatcagttcatcctgatccttcgcatggatgatgcgttctacattttcctcttctgaacaaacaatcgcaatttgagaaagaatatcgaggtgttcgttgtttttacctgcgatgccaaagacgactttggcgatatttccttcgccgtattcaacgccatctggaatttgaatgatggaaatcccagaatgaaggacagctgctttcgcatcctctgttccatgaggaatcgcaatcccgttgcccataaatgtagacgaaatattttctctttcaaacattttgtcaacataatcacctgtgacatagccatttgccactagaacttcacctgcttttttaatggcttcttctttcgagcctgcttgttcgtttagaaaaatattgtcttttgatagtacttgtttcatgaatgatcacacctttttttagaatggaaaatcaggaaaacaaccaaaacggggagttcaatgaagaaaaattgaactcaacccgtttcgtcatgttattttttcaatttctcaatcagctcatcgtatttcgggctgtttaagaaattatcgactgagatatgcacagcgcctggcagttttgccttggctctgtctgttaaatctttatgagtgaagaccacatcggcatcatttggaatgttgctgatggatgtatttgtcacatcaatatcaagctctgcctttttgactttattctttaagatggatgcgcccatcgcgcttgagcccattcctgcatcgcaggcaaagatgattttgttcacttcatctggattgacatcacttggagatgctgcttgctcatttgcttcagcgtcttctttttgtgctgtaagagcagcggctgctgcgcttttcttccctttcatgtcctgcattttttctgttgcggctgttaagtcttcgtcaactgcttttgaggcttttaaaatcacagaagcgacaaggaatgagacgacggctgccacgacgacacctgctagaacagcaagatgtccgccttttggtgacatcagcataagggcgataatacttcctggtgacggcacagcctttaagcctgcatttaacagggtaaaggtcaaaacgccactcgctccccctgcaattaccgctaaaataagctttggtttcattaagatgtacgggaagtaaatctcatgaatccctcctaaaaattgaatgacaatcgcacccggtgcagactgctttgcattccctcttccgaagaacatgtatgcaagtagaacacctaaacctggtcctgggttagtttcaagcaagaacagaacagactgccctgtcttcgccgcttgctctacccctaacggacctaagatcccttggttaatcgcattgtttaagaacaagactttcgctggttcaatgaaaatacttgccagcggaagcaaatgtgcattcacaatgatatctacacctgccgcaagggctttatttagaccaagtacaactggtccgatagcatagaaggcaatcgcgacaagaatggcacctagaatccctgccgtaaagttattcacaagcatctcaaagcccgatttgattcgatctttgaagagctgatcaattttcttaatcaagtaaccgccaagtggtcccatgatcatggcacctaaaaacattggaatgtccgaaccgacaatgaccccaatcgtcgcggttgcaccgagtacaccgcctcgatggtcgtatacgagtttaccgcctgtgtaaccaattaagagtggcagtaagtagttgatcattggaccaacaagtgaagctaattgctcatttggcaaataaccactcggaatgaataatgccgtaatgagtccccaagcgataaatgcgccaatattcggcataatcatgccgcttaaatagcttccaaagcgctgtacttttacgcggaatccgcttttttcctgcatctatgaaaactcctttcttctctccctttattcagggctttataggtcaaaagatataagaacaagtgtcagtgaagcccttatccctatcgtaaaacgctttcactttcccttcaattgaaactaaatgtcactttgtcacttagtgtgtgacaaaattgaaatatgatgtgaattctctgtcagaacatagggcaatcggggtaaaaaggttaacgtgccgtggttttgacgcaaaattcattggaatttcacaattttcaaatcgtcacttcttgtttcctcttcttaaatcgaataggcttatacttgatcaaacctattcaatcaagaatgtctgcgcagacacgacacagaaaaagtgaaccatcttgctgtttgtttcgtttaccttttagagtgagcggcacaataggaggagcggttttttctgtgacccacagtttactgccgctttctttctgatacatgagacattttcataggtagaaaggcggttatacacttgttgaaacatagtaagtggcttctgcttcttatcgtcacgttcgcttttttcattccaaaggaagcatttgcccatgcatacgtcgtcagctcgaatccagcagcaaatgaagagctggagaagcagcctccttcggtctctatcacatttagtgaaggaatcgaaagtggatttcatgccattaaggtgctaaatgcaaaaggggatcgtgtggatcaaggagatacggtcattaaagatcaaaaaatcatggaagctgctttaaaaaaggatttaccaaaggggatttatactattcagtggaatgcggtatcagcagacggacactctgtctctggcatgatcccgtttagtattggcaaagcggatggcggttttgaccaattagatcaaggtcaaccaaatgaatcgattgatgttgcctcgaccatagacaaagcctttctttatacgtcgtttagcttatttctcgggaccattttgtttggactgttttggtttcgggcagcgatttcacctgtattagcgaaacgaatgaaacggctgttgtcattgtcactgatcatgatgggcggagcgctcgtgttccagctgccgattcaaacaaaatcagcggcagacgtgtcctttttgggagcatttcagccatcgcttttacaagaaaccattgcatcgacttctggcggtaatttgtggatgatgctcatggtgtcatttgttcttctgaccatttggagcatcgttgcgatgaaaaaaggggatttcacttcttttcgggtatggttgtttccactgctcctattcgcagtacttctctggctgaaggcacaaatcggacatccagcggcaactgataataaaatactgacaacgtcacttgattttatccatctcgtttctgcatcgatctgggtcggtggtttaacagccattgtgcttttattgttgaagaagctgccaaatgaagatcagccgctcatacggaatacgttaaaggcgtttcacccttgggcactgctctctgttggactcattgtgttttcgggatttgtgaatgcgatctttattttgcaatcgtttgatgctcttttcgaatcagcatacggtcgaacctttttaatcaagcttggtttatttatcttgatgggccttcttgggcttgtccattacttgatgctgagatgggaaaagaaacagaaacaaaacgtttcgttacgagctgagtggatcatcggaatcgctattttgttattaacagctgtattcaccaatattccgagccctcctccgcctgcacctgagccgttcttcggtgcaaaccaagtggagcatcgtgacattgtgtccatgagcattaccccgaatgccccggggaaaaacacattcgaggtcgcatttacaaagaaggatggacaaacgattacagatattcaatctgtgtcagccaagatccataaagtcgccttattcggtgaagagaaaccgagtgaatttcagctgaaacgattaaaaaatggtcattactctgctgaaaacctcttgttaaatgaaaaaggcacttggaaaattgaaatccatgcgttaactggttcttttgaaaatatcgataccacatttattagaagaaactaaaaggagttcataccatatgaaaaaatatgttaaagctttattaccaatgcttctcgcttcatttttattggcgattcctgtgagtgctcacgtcacagtcaaacctgatacgtctgcgacaaatgcttgggaaacctatacgttaaaagttccttctgagagtgacagtccaacgactaaggttgtcgtgacaatacctaaaggcgtagaattccaacaatatgagcctgtccctggatggaaaacatcaactgaagaaaaagatggcaaggtaacaagagtgacttgggaagcaactggtaaaggcgtgcttgccggacagttccagcaattcgtttttgtagcaaaaaaccctgaaaaagcaggtgaagctgcatgggatgcatatcaatattataaggatggaacggtcgttgaatggactggcgataaagatgctgataagccgcattcgatcacaaacattgtcgcatctaatacggtaacggattcccatggtcaagaaaaaccaaaagaagaaaaggcatctgaaacagcctctaattctccttcaccacttgtgctagggttgtccattgctgctctagtcgtagcactgattgcgcttgtgcttgcttttagaaagaaataattcatttgtaagcgatcgttttcacggaaacgatcgctttgtttttccaccttgcttgaacacgaaatgcaagctaggacgatcaactcccatttcctcagcctattattaccaacataggattgaataggatgatgacgcatgccataatgagacacatgaccacctaggaggctataagatgaaccatctaattatatttgctcatccccagcaaagcttaaatcaaaccctattagatcttgttgtcagcactcttttgaacaatggtcatcaagtgactgttcgtgatgtttatgctcttggtttttcaccagaactaaacatcttggaaaaggctgcgatcaaacggggtgatgtccccattaccattcaaacagagcagaagctgattcagaaagcagatgtcctaacatttattttccccatttggtggacaggcttacccgctatgctaaagggctatgtagaacgcgttttttctgagggcttcgcttatcaaatcaatgagcacggggctattgataacctgcttcgacacaaaaaaggtgtcataatcaacacgcacgatgctccaagatcctttcttgacgctaaccgaatcgttcccgcctcccatcgcatgacaacggatacagatgtcttcaattttattggtattgagcctgttgaacgacttttgttcagcagcatggagcaggcaccagcagattacatccacgaaattctgaaagaaacaaaagaaacggttgagcagctttttccgccggctgtttaacataaaaaagactgccaagatacatcaggcagtctcagattgttgacaaagggctaaaatgatctttatttagccctttgtcttcttttcagcgtgatagaaaacctttgcaggctaggaaggacgagcaccggagcggagcgaatttgacattcgtgagcaccgaagcgcagacctgacaccgaatgcgagggtttgtctacacgctgagactgccagattcctcaggcagtctctttcacgtttattcgtctaaaccaatggatacatatttggtttctaaataaggctcgatcccttcgatgccgccttcacggccaattccgctttctttcattcctccgaatggtgcttgaacagccgatgggccgccatcattccagccaataatcccgtaatcaagattctctgagatgtagaggccgtttcgataattctctgtaaagaaataagctgcaagaccaaacggtgtatcgttcgctaattcaatcgcttcatctagcgttttgaatgtcgtaatcggtgccactggcccaaaggtttcttcatgcataatgttcatcgaagggtccacatgtgtgagaaccgttggctggacaaaataatacgacttgtcatcatcgaaatgcgtatctccgccgacaaggattttcgcccctttttcgactgcatcttgaatttggctgacaattttatcaaagccgcgcttgttgataattgggccgatggatgtgccttcttcaaagccatttcccactttcagcttttcgacctctttgctaaagacttgagcaaatgcttcatgaatgtcttcatgcacaattaagcggttggcacagacacaggtttgtcctgcattacggaacttagatgccactgcttgtttgacagctagttcaagattggcatctttgtctacgatgagcggggcatgaccgccaagctccattgatacgtgcttgactgtacttgcactgtttttgatcaaatgctttccgactggcgttgagcctgtgaacgtgattttgcgaatcaatgggctatctgtgaaaatttcaccgacttcttttccatctccaaccacccattgcaaggcatcctctggaattccggcttcgtggcctaatttcacaagttcaatagccgtcagcggcgtgtcttcagcaggtttcacaataaaggtacagcccgccgcaagtgctggtgctgcctttctcgtgatcatggctgcggggaaattccacggtgtaatggccgcaacaggacccactggctgttttgtgacaaaaaggcgcttgttcgccgtatgggaaggaatggttctgccatagattcgtttggcttcctctgcgtaccattcaatatatccagccgcataaacgatttctcctaatgcttcttgatacggcttcccgttttcttcagtgatgatttttgcgagcctttctttatgttcaatcatgagatcaaaccacttgcgaatgatattggcacgttcatgtgctgacgtttttgcccatgttttgaatgctttatgtgagcgagtgatcgcatcttcaatctgttcttttgtatgctgagcaactgaagcaatttcttctcctgttgcaggattatacactttgagttcgtttgtcatgctctaccgtctccttcgttcttggattcattacatatagtatatacccaatgagtgcccaacctaaaagcaatatccattcagctggccatgataaggaggccggcatccctggaaaataaaatgaaagaaaaaggagactcagcccgatggctaaaacgcctgtcgtccgccaatatttaatgcggtatggacgctcaagttctggttctgctttgcgaagtttcacaaaggcaatggacacaattaagtagccgacgatgatcccgacaccgcctgcattgacaatccacacgagggcagggcgccctaataatggagcgaaaaaggccaaagcaccaagaaataaaatggcatttgtcggcgttttatactttggatgaatatacgcaaaccatttggaaatcatgcctctttccgccatcgcgtatagaatacggcttgcaccgatgataaaagcattccagctcgttacaatccctgctacaccgccaatgacaagcactgtcccaaatgcttgatgaccaagtagctgtaccatcgcatctgctgtcgccaaagaagaggcttcaagctgtccttttgacagccccgcagctactccaaagacaataagcagataaaatacgaccgcactcacgatagagataattaaaattctcccaatgattttctttggcgcattgatctccgccgccacttgaggaatgacatcaaagccaacgaataaaaagggaatcatcactaaaactgccatgagaccgccaaccccgccttgaaacatcggctcaaggtttgctagatttccgttaaatgtggcgccgcctaaaagaagaaaacctgtcaggataatggccactgtaaaaacagattgaaaaatagcggctggcttggcaccaatgtagttaagcgctgttaaaaataaagcaccgccagatccaatcaacacccatgtaaaataaacgtcccatccccctatattccatagaaagccaacatgttgtgttggaatgacataatcaataacagttggcagtgcgactgcttcaaacgtaatgaccgaaacatagccaaacaacacgccccatgccgagacaaaagcggattttatcccaaatgcccgctggacaaagacgagccctcctcccgtctctggaatcgcagacgaaagttcagcatacgtcagtccaataaagatgacgagaataccacctataacgaaggcaatcacactgcctaaaaatccagctgttaaaatccaatctcccgaaagtacaacccagccccatccaagcattgcaccaatggataaaaacagtacgtcagactgtgacatggtttttgccatttgttgtttttgcatacaaccatccccctttgttgtttagcgtgctttgaaggcgtcctcgatgatccctagtccttcatgaagcagctcatctgtgatgacaagtggtgttaagaagcgaataatattcccattaatccctgccgttaataagagcagtccgtgctcgtttgcatatgatgcaatcgctgcggctgttttcttatctggtgtacgcgtagtttgatcttctacaatttcaattgccgccattgcccctaaccggcggacttccccaatgaatggatacgccactctccaatcatttgctttctcctcaatgacttgtccaatgtgttcagatcgttgattcagttgttctgtttcaataatatcaagaaccgctagcgctgccacacagcctaatggacttcctgcatatgttcctcctagctcccctggatctgccgcatcaagcagttcttttctgccgacaacaccgcttagcggcaacccagcagcaagagattttgacacagtgattaagtccggcaccacatcaaagtgctcaatggcaaaatatttacctgttcttgcaaagcctgtttggatttcatctgcaacaaacacaatcccgtgctcctgacagaatgaagctacatgctgaacaaaacgcttcgatggtacaatgaacccgccctccccttggactggctccatgaccacacacgcaacggtttctggtgcaacagcagcgacgaagaattgattgaattgatcaatgatgtactcatcgtaggctgcatcgcttaatccttctggtttctgatagtaatacgggtatggcgcttgatacacctctgacgcaaatggtccgaacccaaatttatatggcttgaccttactcgtcatgctcatcgtcatattcgttctgccgtggaagcctcttgtaaacgagaccacggcctgtcttttcgtatatttacgtgcaattttcaccgcattttcaacagcttctgcacctgaattaaggaaaatggctttcttgtcatggtcacctggtgtaaggcggcatagcttctctgccaattcgatatacgattcgtacatcatcacattgaatcccgggtgaatcaggctgtctgcttgtgctttgacggcttccacaacctttggatgtgaatggcctacatttaacgtaccgatcgcgccagcaaaatcgataaaacgtttcccatcgatatcgaacagctcggcacctttcccctttgctgcaagatgacggttgccattactcacgcctcttgcgacgtattgatctcttttcccctgccattcctcagttgaaaaacggtttgttgtcgtttgactcattgtcatccatcccctttatgtcttttttattattctgaatattttttggtatgatagaaagtaccaatatcatttttttcatggtaccagagaggaaggaatgacaagatgctgacaattcaactagatcaaacaggggcaaacggatttatttatcatcaaatttactcgaaaattaaaggtgaaattttaaatcgaaaccttcagccgcacgatcaattaccgtccaaacgagagttagccgatacattaaatgtcagcgtcaattcagtgaatggcgcatatcagcagctgcttgccgagggatatttatattcggttgaacgcaaaggttttttcgtggaatcactcgaaacgtttcatgaatcaggtcagctgaaaccctctactctcccagcagatttaaaggaagagccgattgcacgagacgattggtattccttttcacatatctctgttgatacagccaattttccgtttaaaagctggctgaaaagtgaacaaaaggcgatcagtctccaccaagaagcatttggtgagcttccgcatccacaaggcgtgtacgagcttcgggaaacaattgcccggttaatcgggcttgcacggggagtcaaatgctatccagaacagctcattttaagtgcaggcacgcagtcacttatccattcgctatcaagcattcttccagccgatcaagtatacgggttagaaaaccctggctatcgccggctctatcaaatgctaaaaaacaatcatcaccaaattgaaacgattggcattgatcaaaaaggagtacggatgagtgacattcagaagaaagagccgaatgtgttgatcattaccccttcacatcaattccctacaggggtgattatgccaatttcccggcggattcagctcttaaactgggcagccgatgagcaagaccgttatatcattgaggatgattatgacagtgaattcaagtatgggactgacagcattccagcgctgcaaagtttggatcgatatgacaaagtcatttatatggggaccttttcaaaatcattgctgccaggcttaaggctaagctacatggtactcccgcagcatttattgagacgctataaggaagaacaacacttcttcattcaaacagccaacctctttacacaatacacccttcttcattttataaaagatggagcatatcaacggcatattaaaagaatgaatggtttatatgaggaaaaacggaagcagctcattggagagctcaatacggtttttgctgacaatgtgcggattattggggaaaatgctggacttcattttatcgcagagttccgttcaaaccgcacgcagcatgagattttacagcgtgccaaagaaagaaagctgaaaatgtatgggatggaccgttttacccttgatgagcaattaccggggcatcaggaaggctttgttccactcgttcttggcttctctcatatgcggccagaggatatagagccagcggtaagaagactgtatgactcgatttatggaaaataaaacagccagctgcttttctagacagctggcttaccaccgctctttatctacggttaaaatggatgatacgagtccaggaaaagcggtctcaatgtcttcttttcttaaagaataatagcggtgttttccgtcaattctcactttcacgatgcctgcctccctcaacactttgaagtgatgtgacagcgtggatttggcaatattcatctcatacgtgccgcatgtcctctcgcctgcttcagctaagcagcggacaatttctaaccggattggatcggccaatgcgtgcagcaccgaaatcagtctcatgtcttcttgggttggatggattggattattcatacgataaatgtatcgtatttcgtgccaacatacaatctccttacccgcctcacaaagtaacgatacatccttcggaaacgactatgactatataataactttcttgtgaaggggaggatctcatttgacacgaaaatgttggacttacttatgtttaatgttactcaccatttgcttatgtggatgccaatccgtccggtatgccgaatctaaaccacctagtgcagaagaggtattagctctcgatgaacaggcagatttatttcaatgggaagaaacggtctatgaagcaaatgtagattgggcccatcaactaaccgtcactaaagatcagcaagtaggtgtgattcagaaaacagctgccgaacattttaatcacggcacagcttccaagttgaaaaaagggacagcgatttactctgtaaaggaacgagaagaccttttaatcgccgaacttaacggacagatcatcatatatgccgcacatgcggaaggataaaatacctgtcatcagataggtgtttttttaagtttcttttcttgtcataggtcattggttttgttatcatagcaaaagtgaccactcggtttccattgtgaccatatggttttgccgattcggaaaggacttatgaagatgaacgaaaagcaagaagagattttgcgggtttcaaagaaattattttctcaaaaaggctatatgagtgtctccatgcagtcaattgccgatgcctgtaaaatatcaaaagcgtctatttataaactgtttgattcaaaagaagctcttctattagaactgattaaatacaatcagtgcaaaatgagagagatttctcaaatcattcattcagaaacgacgctgtccaaaaaggaaaaattcacaaagaagatcaagcttgagcttgaagagtttaaagagaatcataaatttttgaatatgctgtcctttgaagctttttcacagcattcgcccattgtcattaagcatttacgtgagacacgctccattatcatgcagcggcacagagacattattttaagcacatatggtgattctgttgcgccttacgtctgggatcttgtcattgtcctcaacggattaatgagagaattcattttaatgctggcgattgagcgcaagaacatccaattagaaaatgccgccgaaatgattatcggcgtgatggaccgtgtgtcgaaaaagccttgctctattgagcctgtgctaacagatcagctgatggactcttatttgctttccacacaggacgaatacgatgaagaaaagcttgtcatctcgtacttaacgaagatcaaacaagagcttcacacactgtcaaacggtgaagaaaaggacgatttcctctctgcgtttgaactgctaagtgaagaattatcaaaggaccaaccgagaacctttttaattagttcactactcgattatttaggaaaaaacagcgttttatcacaaaacgtgtcacagctgaaaagcatcatcttatagataaagaagggataacatgaaccaatctacaacatcgtataatcgatctgtgattgtggggattttcctcgttggggcatttgtcgcaattttaaaccaaacattgctcattccagcgatcccacatatcatggaggaattcaatattgatgtcagcaaagggcagtggctcaccacagcctttatgctgacaaacgggattctcatcccgatcacggctttcttaatcgagaaattttcaagccgttctttagttttaacggcgcttagcatctttacagccggtacaattcttgcttcatttgcaacgaatttccctgtattacttgcagcgcgtattgtgcaggcagccggtgcagggattttaatgccgctgatgcaaacgatctttttaaccattttcccgaaagaaaaacgcgggcaggcaatgggcatggtcggacttgtcatatctttcgcaccagctcttgggccgacacttggcggctggattgttgattccttcagctggaagttcctgttctatattgttcttcctataggtattattgatcttattcttgctttcttcttaatgaaaaatgtaacgcagcaaagagagacacgtattgatgttttatctgtcatcttgtcttccttcggtttcggcggactgctttacggattttctagtgttggcacatacggctggacaagtgccactgtcctcatttcgctgattgtcggcgctgtgagcttgttcttctttattctgcgccagtcgaatttgacaagaccgatgcttgaatttggtgtctttaagtttgcaatctttagcttgacgacatttcttgggatgcttgtctttgctttattgattgggacagagacgattctgccgctctatacgcagaatgtgagagggttgtctgctcttgatacaggactgatcttattgccaggtgctctctttatggggctcctctcaccaattattggacggatttttgataaagtcggcggaaaagggctggcattaggcgggtttacgatacttaccgtgacgaccttgccatttatgctgctcacccttgattcatccatcgccctcattacggtcgcgtacacgcttcgcttaatcggggttgggatgatcatgatgccgctgacaacagcaggtattaactctttaccacctcatttgatcccgcatgggacagcgatgaataacacgatgagacaaatgggcggttccattgggacagcagtgcttgtctccatcatgagcagctctgctgcaaatgcagaattggccagcccattaaaatcagccgttcatggaatgaatacgtcattcttcatttctggtctgattgcggtcattgggcttgtcctctcctttttcttaaaggaaaaacgcaataataaagtgatgaagcaggagctatcttcctcctcatcttcttcataagaaaaagagctcggcatatggccggctcttttttcatatactcacgctataccgtcctccctgaaaatacatttgtatttctagtgaagaaaaaccttgataatttgaagaaaagagttgataataggaactattcaatttgtgagaaaatttttactataggagatgtatgcattgaaggtcgttaaatttggtggcagttcacttgcttctggcaagcagctgcaaaaggtatttgacattgtaacagcagatccagctcgaaaagcagtcgttgtttccgcaccaggaaaacggcattcaacggatacgaaggtcaccgatctattaattagctgtggtgagcaatatttacgcttaggtgaagcacacgatttacaggaagccgtcattgaacggtatgcctccattgcggatgaactcggattaagtcatgacgtgattgacaccatccggcaagatctagatgccctcttacaggctgatacgtctcatcctgagcgatatcttgatgccatcaaagcaagcggtgaagacaataacgcaaaactcattgccgcctatttccgctatcaaggtgtcgaagctcactatgtgaacccaaaggaagctggtttatttgtgagcgatgagcctggtcaagcgcaagtcctatcggagtcatatgatcatttgtataaattaagagagcgctctggtatcatcatattccctggcttttttggctttagtctatcgggggacattgtcaccttttctcgcagcggctccgatattaccggttccattttggcaaacggtttgaaggcagatgtgtacgagaactttacagatgtggatgctgtttatactgtcaatccaacgatcgttcatgagccaaaggagattacagagcttacgtaccgggaaatgcgcgaactttcctatgctggtttttctgtgttccatgatgaagcactcattccggccttccgtgcaggcattccagtacagattaaaaacaccaataatccttcggcaaaaggcaccaaaattgtgaaccagcgggatcatactaatggacctgttgtcggaatcgcttcagacagcggattttgcagcatttatattagtaaatatttgatgaaccgagaagtcggttttggacgcaaagtgctacaaacgttagaggaatatgggcttacgtatgagcacgtcccttctggcattgatgatatgaacattattttaaggcaggatcagctggaggagcagcatattgaacaagagctgctcgaccgcttgaaggatgtgcttgatgcagatgaggtcgtgttagaaccgcatctctccctcattatggttgtaggagaagcgatgcgccacaatgttggcaccacagcaagagcagcaaaagcgctgtcaaaagcgaaggtcaatattgaaatgatcaatcaaggatcttcagaggtcagcatgatgtttggcgtcaaagcggctcaagaaaaagaagccgttcaagcgttgtatgaggaatttttctctatgtctaccgtccctgtctctctttaatcagcaggctgtcagatctcaggatcggcagtcttttttgttctcacccgattcacatggatttacgcattaaagtgtatctatttctcgtttgattttgtatgatagagacaaaccaactattgttccggcctatgagcggagctacaaggagtcctaaaacaatgcctcgtcaacaactattaaaacagtttcgcaactttcatgatgcttctacgagtattctaaatatgatgagtcaattcactgatgtgaatacactgtttattgctaaaaacgatcaaaccaccaatcagattgtaaaggtgttaaatcatgacgagcagcttcttgaagaaggggaagaaattccttacgagaagacattttgcaagctggcggtcgatcatcacgatacgcttgtgatccctgatatatcattggatgatcgttctaaatccttagaagtcacgaaacgtcttcaaggcggatcattcatcggagtgccgattgattttacagatggtacgaactacggaacgatttgcgggcttgatctaaggccgcagcaattcacagaagagcatgtgcatatgtttgaaacgatggcttctctattaagctacgtccttgaactagaccgtgccaaccggcagattcagcaattatctgtaccgatcgtcccagttgttgacggtgtcgccgtgcttcctctacttggtgatatcgaagagacacgtgctcagcatatattagaaaccattttacaggaaagctacaggctgtcgctctctcatttggtcattgatgtatcaggaacaaaacgcctgaatgaacagagcattcaatatctggtcaactatgcacaaacgctgagacttttagggatttctgctgttttaacagggattaagcaagatcttgctttaagtgcgattcaatcgaatatatcatttaaagacatcaccattaggaaagacttgccgcaggcacttgctcatattggcttaacatttaccaaaacggaataagaaatgatagacacaaaaagggctaaatcaattttagcccttttcttctttttaaatcatgccaacagctgcaaataagaagaatcgtttccgtcttcaataacttgtacaatcttctgtgcatgtgatgcgtctgtgacactgtttaatttttgcatgatgtcttctttcgataatgcatgacctggtgcgcctcgcggaatatcgactcgtttgctaatgatggtgccatcagataaggtgagcttcacaatcgtaaagcgaccttttgggacagcgtctggatggggttctatcgtttgatcatattctctcttcacccgtttcatccaagtgcacatgtttgatggaatgtgttttttcgtaaagacatccagcgtcagcgactgtccaaacgcggcaagtgcgatcacgtattcgacactaaatcgtccttcttctccagtcgaaggtgtccgctcaataagcgctgcatctccgccaggcgggaacaggacatctacttgtttcacctgttctggcaagaaagcccgctctttcattaaggattggatcgcatctgctgcatggtgggcagctgagcagaatggatatactttgaaccacagccctggtgaaacgatacgccatgtagaaccatagccctctagtaaacgactttccgcaagttccagatctccgtagagtgaaaagaaaccaagtgcgccatcaagaaccgagtcattgccaccaaaacctgaacaagctaagtccatagaccagacggctgttttagccgctaagccagcttgtaatggtttcatatcagagccgaactgctttcgcattccggcagattgcgctccagcaaagccgattgccttcatcagctcttcctgcgagacttgttttaaatatccaatggcacatactgccgcaatggctccaagggttccggtattatgccagccccgctcataatgcgcttttccgatggattcaccaagccttgccatcacttcaacacctgtgatgtaggctgctaaaaatcgatcgccaaaccctttgccgtctgatagctgtgaaagcaaggctggaatgatgactgcacttgggtgtcctctcacgtctgaatgcacatcatcataatcaagggcgtggatcaagtagccgttcagcatcgctgcggattgacggctgaccttcttcccttgtccgatgacaggaatttgagctgctccgccttcttgttccacaagtgccatgagcttttgaattccttcgtcctctttcgcagcaagcgctgctgccgcagcgtctaacagaccatttcgagccatttctaccgcccgctgatcttgaagtggatcagcagacagtacagcctctgccaattgttttgttaattccatgatcgtgactccaatgcccgaacagcaagctcggcaaagtaggcagctgcaactggaagtgcgtcttcatttaatgtaaaggcagggtgatgccattcctcggtaccgcttgtccccatccatacgaaaaagcctggaatgcgttcttgataaagggcaaaatcttctccgcccggtgactgctctgcttgaacgactgtgagattcagcgcacctgccgtttcttcgaccacctttgtcaaacgatcgtcattcaacacagaaggcagatatggatgccatttcacttcgccttttgccccaaacccttcggcaatcccgctcacgatttgtttcatgagctcgggaatcatcgctctcacttcaggctcaaacgtccgaacagttccttccatctcaacacgatcaggaatcacattccatgatgtaccgccttgaatacgtgtaatgctgacgactgcatgatgcaaagagctgatgcggcggctgacgatttgctgaagagcacttgtgatctgcccactgatggcaatcgggtctaccgtgtgattcggaatacctgcatgaccacccgttcctttaatattgatttcaaaccggtctacacttgccatcaatgctttttctctaatgcctatagtgccaactttcaggtctggtttgttgtgcataccaaaaatggcatccactccatctaaaacgcctgcctctatgacatgtttcgctccttgcgcgacttcctcagccggctggaacaaaatgcggaccgttcctttgagctcgtgttttcgttcttttaataaaagagctgctccaaagatagaagctgtatggaaatcatgaccgcaagcatgcatttttcccggtacctttgaggaaaatggttcgccagatgcttcttcaatcggaagtgcatcaatatcagctctcagggcaatcgttggtccctcttgttctcctttgatttcacagacaacacctgtttgaagagctggaaaatcgagtacggtgatcccctcctcctctaaccagcggcgcagtttttttgtcgtttcatattcttcaaacgccagctctggatgctcatgaagcgctcggcgaatgttaattaaacgtttgtttaatgcttcatttcctaatgatttcactgatactcacccctctaaagagtaaaaagcagcttatgcttcttcagccgctgcttctttttggataaatcgttttgtccgttcattcttcgtttcatcaaatagctcagttggtgtgccctgttcaataatatgaccatccgccatgaaaatcacatggtctgccacttctctagcaaacgccatttcatgtgtgacaatgatcatcgttgtttcttggatcgcaatggacttaatgacttgaagcacacctgagacaagctctggatcaagtgctgacgttggttcatcgagtaaaatcgcatgtggatcaaccgctaatgcgcgggcaatcccgattcgctgctgctgtccgccagataacgtgactggatagctgtcagctttttgctctaatcctacttgcttcagcagcttcattccaatctcatttgcctgctgcttcgtcatttttttcgtcacaagcagtgattctgtgatattttgcagtgctgtcttgtttttaaacagattgtagttttgaaacaccatggccgtttgttgacgcaggtgatgggcttcttttcgtgtatatttagacgcatcgagcttcgcatcgccaatttcaatcgtgccttcatctggtatttctaataaatttaagcagcgcagcaaggtggatttaccggagccagaaggtccgataatggccacaacctgccctttttgcacatcgagattgattccgtctaagacgacaaggtcgccgaatgatttcttcaaattggtgagcttgatcatgtccacacctccttaattccggtaaggtttgctaatttttcgttcgaataggtcttgaaggaagctataaatgatggtcatcacccaatacacaatccctacggctaaataggtttcaaagtatttatagttcgccgacgcaatcatcttcccttgtgcaaacatttctgccacaccaatcgtaaaggcaagagatgtttcttttaaaagaccgataaaggtattccccgtcgctggaatcgcgtttcgaattgcctgcgggaaaataattctgacgtaagactgccatcttgtcatgccgacagatagacaagcttccagctgcccttcatctacagagttgagggcagctctgaaaatttctgctaagtatgctgagtttttaatacttaatccgataatgaccgctgttagagcatccattgaggtcatcgcagggaatagctgcggaagaccaaaataaatgagaaagagctgaaccaaggttggaaccgctctgaaaaaagaaatatacagcttggcaaattggtacaaaacaggtatccggtttttcgtaatgagagcgaataccacaccaatgataatggcaaataccatggagacaatcgccatgaagatcgttatcggcaagtattggatcaatgtcggaaaaacggtcaccatatactgccaatcaattttgttcatgtctgctcttcaccgccgctgtcgttattttttaattggcaccgtgacatcatctttgaaatacttctcagacaatttcttcagtgtcccgtcttctcttaattctttgattgctttgttaaattcttctcttagcttgtcatgctttgtatctttggcaaatgggtagcctacttcttcatacacaattgggttgccgacgattttgagcggcagacctgttttttcaatttgagcaagtaatacactgcgtccgttgacataagcatctacgcggccatttgccacttcatttaagacaccatcttgcgtttcatatgttttaatattgatttttttgtccggatctttgctctctaagtttttggcatggttagagccaagaactgccgccactgtttttccttttaaatcatcaagacctttgatgtcattgttgtcctttttcacgatgatttgtgttcctgcatatgcgtacgtatcagtaaagttaaacgtttgtttacgctcatctgtgactgcgacttggtttgacactgtatccagcttaccagatgtcagctgccccattagtccgctgaattcactcagctgccagtctagtttgtagcctagcttttttgcaatagcttcagttacttcaacatcgaagccaacaagcttgccattgtctttataagcaaacggatagctttgccctgtggcacctacttttaacactttttcgtctttgccttcactctgattgcctccgccgcaagctgctaaaactgccagcattgctgcaaatagaacgactagccactttttgtttttcatgttcgtatacccttctttcctcttatggttgtgtaatatctgaccttagttgttttttcaaataaaccgtgatgtgtcccttgcctaaatccttttctcctgctctgacgtagcctttgcgctcatacatgtctatgagccacggatgcttatcagctgtacctagagatacgtatggcacctttaaggtatcccttaggacttcggtttccacccactccagcaagacagagcctgtccctttttgggcggatggttctgaggcaaaccaccaaatgtgagggacgccgaacgggcctggctgttctccccaaggcatacggagcgacaaggtggatagaagctctccgttttcttccatcacatagcagagattcttttgtacatttttctgaacgagagcaaaatcagcatgtgctgcttggaactggatgccgagctcacgaattggctcataggctcttgttgtcagttcaagcagtgcctctatatctgcctctgttgccagacgaaacgtgtatcccaacgttagtcacctcacctttatgtcgtgtagcgattttttggctcagttaatccaagattttctcgcaaggtttttcctgtgtattctgttttgaataagcctctctcctgaaggattgggacgacgcggtctacgaacatgtccagcccttctggcaatagcggaggcatgacgttaaagccgtctgccgcttcttcattgatccaagtttccatcacatctgcgagctgctgcggtgtgccaatgaaaatattatgaccacgagagccggcaaccgattgatagagctggcgaatggtcaggttatcctttctcgccatattcatcacgagatcaaaacggctttttaccgcattggacgcgcttggatcaatctctggaagcggaccatctaaaggatactgagacaaatcaatcccacctaagtagttttgcaaaatgctcagcccaatctcaggaacaatcagctcctgtaattcttcatatttcgctttggcttcttcctctgtatcagcaataatcgggaagatccccggcatgatgctgacgtcctctctagcacgaccagcaccctctactttctcctttaagctttgataaaattccttcgcttttttgagatcgttttgtgctgtgaaaatgagttcagctgttttcgctgcaagcttttgaccatcttcggatgatcctgcttgaatgatcactggctgcccttgaggcgtgcgtgatacgttgagaggacctcgtactgagaagaactcccctttatgctggagctcatgcagcttactagattcgaagaattctcccgtttccttgtttctgacaagggcgtcttcttcccaagaatcccaaagacctttgacgacttcaacgaactcttctgctcgctcgtatcgtttatggtgtgctaaatgctcttctccgctaaagtttttcgctgtttcttcaatagaagatgtgaccacattccatgccgctcttccgcctgataaatgatcaagggaagcaaactgtcttgcaatatggaaaggctcactgtatgtagtggatgctgttgctgctaaaccaattgatgaagtagactcagcaatggacgaaagcagggtgagcggttcaaatctcgtgagtacattcggatgagaggtttggttaatggataagctgtcagctaaaaagagtaaatccagctttccttcctctgcttttttcgctaattgtttaaaataatccaggttcatggctgcatctgatacggcgttcggatgtctccaagaggcaacatgatgtccagttcctgcgatgaatacgcctagcttgagcttcctttttggctgtgacacttgttcttcatcctttctatatcctgctgtatcaaactgaagtcctcagaagatacatttttctgattgaattaatcggttttatcaataaaaaaagggcaaatgttgcgaaaaatgaaaaataattattactatatgccctttttacaggattgtcaaccgccttctgaacctccaaaattagggattttactcattcatcacggtgtatcgatttcaatatttccgatgagccggtctgtagtatgtgtcaccatttgactgcgttccagcatgttatgggcgatcacggaatgagtggagtttgcggtgcggatggcaatcgctttttgaggtgatacattgatgatgttattgcgcagcacacgggctgaggcagcctggtcaataaagatcgctgtcggttgtccgaatgaacgatttaaataaaagcggttatctccgatttgtggtgaaccgtttttaatatacatcacgacatataaagatgattcttcaaaggaattgtctttgatttctaatggccccgtcgtgctgctgtatacggcgtagttttggtagtgcttaaaacgattatgccaaatgaaagcctttgcatttccagtgacactgatcgtatacgaagacccaagctctggatgtccttcttgaataaagtgattgccgttgatcccagcttccccttcctgcacccagatccctctactgaattctttgaattgattgtgctggatcaggatattcgttcctctcaccatcgccccatcgatcaccgaataaatggtattgttcgaaaagacgacgctatccgattgatagatacgcagtgctgcgcttctttgccctgtattcgtccccgattcaatatgatttccttctattagaatacgattcgccatataaacggacaaagccgcatcttcaaacagactgatcttattccctgtaatgtgaacactgtcgcccctcacatcaatccctttttcaaacccttcaatcatattgccaataataatcacattgttttccgtttgaccaagagagatacctaagctcgtaattcctgcttttgtgacgcctcctcctactgcacggatcaaattgttggcaatgattgtttccgtggcaaagccataggagatgctgctatctgtatgattgccttcgatgatgacaccatagccattgaagttataaatggagcttgcggcgccacctctcacaatgttgtttcgaatttgaatattcagcggttcctccatattcactgcattttccccgtagccttcaatatcaatgcccattcttggctcgactccgtttactcctgctctctccagcagacagtcctctacaatgaccccatcacagcctgtgatcgagatattgtttcgtcttgaatctgtaatgtgacaaccagcaatatggatcgacaaagcaggcgagtacgattcagcttgtgataataaaccgtggggactgacaatgatgccgtctcccgtacaatttttgatttgcacacgattcacatctacatcagatgccccttcaatacatatcccaaaaccccactcatgggtttttcgttcagggggaagcgatttatacacatgctcatgacgatccccttcgattcgcccgccccggatggtgacatgctgaacctttcctatataaaaggccgcatacccccacgaatcatttggtttcaccttaatgacggcatcctgtgccatctcaatggttatatgacttggcacacgtatacccgcaccccggaaaggaaaaaattgatctcctctgtacactgcatcgatgacatacgtgccgctcggcagccagacgtgggaatacccctgtgctttcgtccattctaagcattcattgagcttcgctgtacagtccgttttcccatccgccactacaccaaaatcttgtacattgacaacaggcttttttagatcagattcattcaattcccccaacctaaacccctccttttcacacatgtcctcttgtcatcctatgcatgtgtaaaaggtttgcttgtacaatccttcaaattttaaataaattctttcgatataactttctgaccattctcacttgagagaatttttcatatttttgagactttacgcctattgaactaacattttcctgttttagaatagttttatattgacacaagaactatacaagaatatcatttttctcatatctctttttttaagaaaggatctatgccatgtctacaattgaccacgataaaattgttaaaagtgttcctcaaaaagggttttttggacatcctaaaggactttacacactgtttttcactgaattttgggagcgtttctcctattacggcatgcgtgcactgcttatttattatatgtacacagaggtgacaaaaggcggtcttggttttgatcagacgacagccaattcgatcatgtctgtctacggtgcgcttgtctatatgtcaggcattattggaggatggctcgccgaccgggtattcggttcgtctagtacggtcttttatggcggggtgttcattatgcttggacatgtcattttggctttgccaagcggagcaacagcgctctttataagtatgggactgattattattgggacaggccttctgaagccgaacgtttcaaacattgtgggcgacctgtattccaaaacagacccacgcagggattctggctttagtattttctacatggggatcaacatgggcggttttattgccccattaattgtcggaacactcggtcaaaaagtgaacttccacctcggattctcacttgctgccgttgggatgcttattggtctgattacatttgtgatcacgaaaaaaccgaaccttggtcttgccggtacttatgtgacaaatccgttatcagctgctgaacgcaagaacttcaaaattttcggaacattaattgctattgtactcgctgtttttgtcgtcattggcattcaaacaggcgcactcacgattaatctattcacttggtttgtcagtgttcttggggtgctcattccgattgtctatttcatcgtcatgtatttcagtaaaaagacgagcccagtggagcaatccagggtcctcgcttatattccattgttccttgctgccgtgatgttctgggcaattcaagaacaaggctcaaacattttagccacatatgcagatcaacgaacaaacttgaatttccttgggatgacacttgcctcttcgtggttccaatcattgaaccccatctttattgtgctattgtctcctgtatttgcttggttgtggatcagacttggaaagaaacagccgtctaccccgattaagttttcacttggccttctgtttgcaggattatcctttatcatcatgatcattcctgcctacatgtctggtccaaatacacttgtgagtccattatggctcgttctgagcttcttccttgtcgtgatcggagagctctgcttatcaccagttgggctgtcagcaacaacaaagcttgcacctgctgctttctcagcacaaacaatgagcctttggttcctttcaaatgcgatggcacaggcgatcaacgcgcaagtggtcaaactgtttgataaagtgccagaaaccgtttatttcggtatcattgggttgctcgccatcgttttatgcggtgtaatgctgctcttaacaccagtgattaagaaagcgatgaaaggtattcattaaataaaaaaagaagcctccccattgggttggcttcttttttctagtttaaaaccgtatctcatcatctccatgaatttgcagcttaagcggttcacttttcgcctgatgctttttcacatagcggtgatagacaacatacccaatgatcatgagagggacgccgacatataatccgatgcgctgttcttgatcaaaggcaaggctgaccaaaacaatggtattcagcgtgatcgcaacaatcggcagcaccggatagagaggggttttaaattttaagttttccagctttccgcctgctttaagatatcttctgcggaaaagcatctgtgataaggtaatggtgatccagccagtctgggcactcataccggcaatggacacgatccaagcaaataccgttttctctgcaaagaacccggataatagcgaaattcctgtaaacaggaacgtgagcagtaaggcattcatcggaataccacgctgattcacgcgtctgaatgcttttcctgccattccttctttcgataaggaataaagcattctcgtcgatgcatacaagccagagttggcaacagataataaagcgatgataatgacaaagttcatgatatctgccgcaaaaggaatgcccgttctctcaaatacagtaacaaacggactttgcagcacactcgcttccttccaaggcaccatacctgctaagacgaagatagataggacgaaaaagacaagtgtacgccaaacagtctgatgaatcgaacggggaacggttttttcaggattttcactttctcctgccgcaatcccgatcagctctgttccttggaatgaaaagttcacagtgatcatcgtgaccaccacggcgagcaatccatttggaaacagcccatcactcacaaaatgactgaagtaaggggcaggttcaccgctcgttgtttcaataaaaccaaacatcgccgcgccgcctacacctataaagagtaaaatcgcaataattttaatggttgaaaagaaaaactccgactccccgaacgctttcgccgaccgggcatttaataagaaaagacacagtccaaatatgagacaccaaatccacacatccacttgaggaagccagcgcctcatcagctgtcctgctgataaaaattctagggcgaccgttgctgcccagccaagccaataaatccagccaactgcaaaacccgctgcagggctgacaaatttcgtcgcatacgtatgaaacgacccggacacaggtagtgcgaccgacagctctccaagacacagcatggttaaatacataatcaatccgcccacaatataagaaagaacggctccaactggccctgcttgtccaatcgtatagcccgttcctaagaaaaagcctgtccctatgacaccgccaagtgaaatcataaataaatgacgggaggtcatcgcccttttcaattgctcaggctgattttgtccaacatccacaatgatgccctccttcttctaagatgttcttttatcaaaacatgtctccatgcgattcatttcattttcaaaacaacctactaattatacatcttttataataaatatgcttccttctatggtcactgtctcaaagtctttattttagtaatgttcgcacaaataaaagatgaaaggctttgtagacgtgagaggtttgaaagaaatgggcagcgggcataaagttggtgagattcgctcaagctagtttcaaatgctttacttttaggttgcttctctgtaagatcatatgttgtaaataccaacaagaaaagtggggaataaaatgaaaaaaatgttctttgccattatgttaggcgtttgtgttgcattgatcactgcatgtggatctggtgcaagcgacaacgcgaataaacaaactgggtctaaggaatcaggcgacctttggaaatccattcaggataaaggtgttctgacgatcggaacagagggtacttatgctcctttcacattccatgacaaaaagacagataaattaactggctacgatgtagaagtcatcacagaagtagcaaaacgtcttgacttaaaacctgaattcaaagaaacacaatgggacagcatgtttgctggactgaattcaaaacgttttgacgtggtagcgaaccaagttggtaaaactggacgtgaaaatcaatacgagttctctgataaatacacaacgtctcaagccattgttgtgacaaaatcagataacaacgacatcaagaaactatctgatgtaaaaggcaaaaaagcagcacaatcattaacaagtaactacaataaactagcaacagatgctggtgctaaaattgaaggcgttgaaggtcttgcacaatcgattcaattgatccagcaaggacgtgctgatctgacattcaatgacaagctggctgtattgaattacttgaaaacaagcgggaacaaaaacctaaaagttgcatttgaaacaggagatcctcaagaaacttactttgcattcagaaaaggcagcggcgaagtcgttgacaaagtgaatggcgcattaaaagaaatgaaaaaagacggtacacttgctaagatttctaagaaatggtttggtgaagatgttacaaagtaataccctaggagtcgtcattccttgggatcttcttcagcaatctttttggccaatggtgatgcaggggatttattatacaatccccctcgccatcattgcctttattattggtatttttatcgcgcttgtgacagctcttgctagaatgtctaaaatcaaagccctcagatggattttttccatctatgtgtcggccgttcgcggaacgccgctttttgtgcaattgtttattattttctatttctttccgacatttaatatcacactggatccatatccaagtgccattatcgctttttcattaaacgtaggtgcgtatgcgtcggagattatccgtgcatccgtcctgtctgttcctaaaggacaatgggaagctggttattccatcgggatgacgcatcgtaaaacactcgtccgcgtgattttaccgcaggctgtgcgtgtatcgattcctccgctatctaattcattcattagcttggtgaaggatacatcccttgcctcccaaatcctcgtggcagagcttttccgtaaatctcaggaaattgctgcagccaacttggatcagatcttgttcatttatatggaagcagccctaatctattgggtattctgcttcattctatcgctcgttcagcatcaaattgaaaaacgacttgatcgatatgtcgcaaggtaaggagggaacgacatgctaacagtcaaaggtcttaagaaatcctttggggaaaatgagattttaaagtcgattgatttttcgatcaacaaaggacaggttgtggccattctcggtccatctggttcaggaaaaacaacaatgcttcgctgtttaaatgcacttgaaacaccaaatggcggctccttcaccttcgatgatttctcaattgatttttcgaaaaaaaataaatcagctgatctgctcaagcttcgccggaaatcgggaatggtgtttcaggattatcacctgtttccacaccgcacagtgcttgaaaatgtgatggaaggtcctgttcaggtgcagcgccgtccaaaggaaacggttcgaaaagaagccattcagctcttgcaaaaggtcggtcttgaagataaaaaagacctgtatccattccagctgtcaggcggtcaaaagcagcgtgtcgggattgcccgtgcacttgccattcagccagagcttatgctttttgatgaacccacctctgcgcttgaccctgaacttgtcggagaagtcttaaaggttatgaaggatctagcgaaggaaggctggaccatggcggttgtcacacatgaaatcaagtttgcccaagaagtagcagacgaagtgatttttattgatggcggcgtcatcgtcgaacaaggtcctccagaggaaatcttcaaacgaccaaaggaagaacgaacaaaacaattcttaaaccggattttgaatccagtatgatgaaaaaaggctgttctcacgtggtgagaacagcctttttttatatttccttttgcaagcgaagcgccagtaaatcttgtaagagcaatctcgctccctctggactgataaccactccgcccgatagcactttgttggagtttgtcacttcccctgtgacaatacagggtttgtcctgccaatatggcttaatgacaatttggtcttcttctcgataaatttccataaaatcgcgcggatgaattttcaaccgttttcttatatctgtcggaagaacaattcttccaaagttatctatatatcttacatagtcttgatttaacaaattgaccccctcctgcatctctagatataggcaattccctttttatcaaggaatgaagcgctccaatcggttagggaaaggataagttgcaggctgatccagtgattaaacacgcttcccatatatgatatatctgtttggtgcaggaccaataaaagaaaaaggatagcatgttgtgaggacaagttcttccttttcctgttgtagtgtaataatactttgatcatctttttttacaatctttgttttctcaatttcataggtaaaccgaccgtatgaaagctcaataacgagttgatctcctttcacaagttctcctgttcgtctaaacacagtatcacgatgcccagataaaacaatttgtccctgttcatttggtaaattgctctcgtgataatgaccaacaccctttgccaagtcctctgcttctgttccttctacaattggtaactcagcgtttaactttggaatgtgtaagagcccaatggtttcaccagccttcggcacaaaaggggaatctgtttcccccttttgctggatggctgcttgtgcagactggaaagattgatctacttgcctttgcccatcaacgatcctcatatatcctatcatcacaaggcaaatgcctgctgtgatcaatgtcgctgagatgattttttgaatcataaacgattatccgtttctttttcttcttttccatacaataagggatgcacctattaatacaagggcaaatcctgctagtaaaaggttgtacatttctgttgcagtgttcggaagatgatgaccaggtgtatccgtttctgaatgagaaggctgttctggattccctggcacctctggcacatgcggcggttctaccgttgttgaattttcaggtttgtctggttcgtcaacattctcgcccttcacaactgcgatattttgaatggttttaccttcagatcctttagcaaccttcgcttcaaaagtaatcgtatgccagtccgtatctttgatatcaccaaattgaccggtcaccgtaccttttgtgtagtctccgttgtcatcatcttttgcatctgtcacagcttgatcatctacttttaatgatccttcgacgtattcaataccttctggcagttgatctgcgatgactagacctttgatgacactgtcttctacactattttttgttttgatggtgtaaaggagagtgtcgcctacctgaacttgtttttcatttgtattgccctctgctttttgagcaatctcagatgttttttctgattcaagttttggatctcttggatcaatgtttatttcggttgtcggctcatctggtggcgtgttttcgcctgttactttcgctgtgttttgaatacttttacctgattggcctttagcgaccttcgcttcaaacgtcacggtatgccagtccgtatctttgatatcgccaaattgaccggtcaccgtaccttttgtgtagtctccgttgtcatcatcttttgcatctgtgacggcttgtccatctacttttagtgaaccttcgacgtattcaagaccttctggcagttgatctgcgatgactagacctttgatgacactgtcttctacactcttttttgttttgatggtgtaaaggagagtgtcgcctacctgaacttgtttttcatttgtattgccctctgctttttgagcaatctcagatgttttttctgattcaagttttggatttcttggatcaatgtttgtttcggttgtcggctcatctggcggtgtgttttcgcctgttactttcgctgtgttttgaatacttttacctgattggcctttagcgacttttgcttcaaacgtcactgtatgccagtccgtatctttgatatcgccaaattgaccggtcaccgtaccttttgtgtagtctccgttgtcatcatcttttgcatctgtgacggcttgtccatctacttttagtgaaccttcgacatattggagaccttctggcaacttatccgtgatgactagatctttgatgacactgtcttctacactattttttgctttgatggtgtagagaagggtatcgcctacttgaacttgtttttcatctttattcccttctgctttttgagagatctcagatgttttttctgattcaagttttggatctcttggatcaatgtttgtttcggttgttggttcatctggcggtgtgttttcgcctgttactttcgctgtgttttgaatacttttacctgattggcctttagcgacctttgcttcaaaagtaatcgtatgccagtccgtatctttgatatccccaaattgtccggctactgtgccttctgtgtagtctccgttgtcgtcatcttttgcatctgtgacggcttggtcatctacttttaatgatcctttgacatattcaagaccttctggcagttgatctgtgatgactaaatttttgacgatgctgtcttcttcaagattctttgttttgatcgtgtagagaagggtatcgcctacctgtggtgtcttttcatctgtgttaccttctgcttttttctgaatgctcgctgccttttctgatgttagttttggctcacgagggtaaatttctgtttttgttgttggctcatctggcggtgtgttttcacctgttacttcggctgtgttttgaatgtcttgaccagcctgtcccttttcaacagtgacttcaaacgtcactgtatgccagtctgtgtccttcacatcaccaaaataacctgtgacctttccatctgtgtagtcaccgctatcgtcgtctttcacatctgtgacagaatctccatcaatttcaagagacccagtgacatacttcagcccttttggcaattgatctgagatgactagattttcaataaggctgtcttctattgtgttttttgttttaatcgtataaaggagggtgtcccctacttctggatgcttctcatctgtattgccttctgcttttttctgtaaaaccgctgatttttctgattcaagcttcggatcacgaggataaatttctacgtttgttgtcggttcatctggtggtgtgttttcacctgtgacactcgctgtattttgaatgtctttaccagactgtcctttttggatcgtgacctcaaacgtcacggtatgccaatcggtatccttaatgtcaccaaattgtcctgagacagttctatttgtgacatcaccattgtcttgatcttgctcatctgtcaccgcttgtccgtctacctcaagtgaattgggcacatatgctaatccttctggcagttcatctgagatcactaagttttcaacaagactgtcttctatcgtattcttggttttaatcgtataaagaagtgtgtcaccgacctctggatgcttctcatctgtattaccatctgcttttttctgcaagacggctgatttttcagaagtcagtttcgggtcacgaggatagatttctacattcgttgtcggctcgtctggtggtgtgttgccggttgtgacactcgctgtattttgaatgtctttgcctgcctgacccttttcaactgtgacttcaaacgtcacggtatgccatttcgcatctttcacttcaccgaacgttccagtgacagttccgtctgtcatatcaccgttatcatcatcttttacatctgtgactggatttccatctacctgaagtgaatttggtacataagataatccttgaggtaacttgtcagaaatcataagatcttgaatcacactatcttcaacagcgttacgggcttgaatggtatacagtaatgtgtcccctacttctggatgcttctcatctgtattaccatctgcttttttctgtaagaccgctgatttttctgattcaagcttcggatcacgaggataaatttctatgtttgttgttggattgtctggcggtgtgttttcccctttgacattcgctgtattttgaatatctttacccgcttgcccttttgctactttcgcttcaaatgtcacggtgtgccaatcggtgtctttcacatcacctatttgacctgtaacagtaccgtttgtaaaatcacctttgtcttgatcctttgcatctgttacgcttgtgccatctaccttaagagatccagaaacataggttaagctgctcggaagattatctgatatgatcagatttttaagaatgccgaattgcaccgtattttttgctctaattgtataaagcaaagtgtcgcctacttctggatgcttttcatctgtgttaccttctgcttttttctgtaaagtaacagatttttctgattcaaggttaggaggatatggatcgaattcaggcttcacccttgaagctaagtcgtaagataatgaatcacctgcagtgcccatatatgttgtacttaatgttttcgcatcaagtgtaaaaagagtagaatgaccaatagagtcatcttttcctgattgtaatagcatttgtccatttggcaaaaagctaattcctcgtactcctccctcaataggtttaccatctgcatttgtgattggaatcactcgaatgacttcagctgtttcaggattcatttgcgcaatggatccactggtattagatgcgaaccaaagatagccatccttatcgacgacaaggtctccgccaatgtctccgccaatgccagggccaacgtcataaccgacaattttcttggacgttttttgaccagttgctaagtcgtacgttgcaaggtagggttctccatcaaccgcatacgaatgaatatatttaccgttataaacaacggcattaggcgctcttccgcctaaaacacctacacgctctgcttgtccagtggtcgcatttattttataaagaactggctctccacttgctgtcgtagttgcatacacagtgttttcttgatcattcactgcaacaccgttcactacagtcgaattaattcccttcacctgtacactagcctttacgtttgttggattttgcccatcaagctgataaagaactaacttcccatttccaatcatgtaggaatctgcgttattgacaaccaccgtcccagcggctttcgtaacaggtggtgaaactgttaataaattcccagcaatcagcaccaatattagaaataattgacttgttctttttaatatgttcattttttgacatccccttttccctgctctaaatcataatggtatgtaccagttcacctcccacactttggtaaagaatatcagtaagatttcaaaagcctcaacaggactaaatgtctattttcgacaaaaatagacatttcgaactacatacctcctaatgattgacctgcttaagtttttccaataaaataactcttttcatcccaaattttcctcatctatctatctttccaaacaggccttatgatgtgaattacatacaatcctttctatttaaagataaatattcttcaattgggtaatgcttatttttttgtcagtatatattgaatttttttcattttctcttaaaaaaagggaatgattggcttgctttgttaaaaaaaacaagtcaaaagtcttgctgcttatcttgatgctttgacctttacgatgcgaaaaaattctttttaaaagtaagcgattacaattgagcaaagccatttaaaggggcgtgggagtatgttacgattgaattcgagtgtttaagaaagaagggaaagcttttgaagcgggaacatcttttacgttggtttttttattttgttggattgatcgtactagcttttggactatcgctgacagtgaaaggaaagattcttgggattggtccttgggacgctttccactacggactgtttcagcattttggactcacgattggacagtggtccatcattattggtgcactcattgtgacactgacttctgtttttacgaaatcatttccaaagatcggcgcattactgaacatggtgctgattggtatgtttatagatttctttaatgcggtattgcctgcaccacacgggtatttacccgctttatatgtgtttattacgggcgttgtggtttcaggttatggtgttggcatttatgtctcagcgaatcttggagccggaccaagggattcattaatgctgctcatctcagcgaaaacaggattaaacgtgcagtgggtgcgaaatggcattgagttaaccgtgcttttatttgcatggatgctcggcggaccaattggcgttggcacgattctgacggctattttcacaggtctcgtccttcgattctccttgccgcaatcgacacggcttctgcagctgcttattacaaaaacagcagagaaacctgttcagacacttatccgataagaacaagccattctacaaaaagaatggcttttcttgtgttaaaataaataaacagaatattctattattggagatgagacctcatgcagcttttccactatcattactggacaccatttgttgaagagaccgagcagtcgtatcgcttgttaggctttgaagtaaaggcgcgtttcactaagggtggctcctttcatccgccgctcacatgggatgattttagagaagagcagccgaccttccgaatcgtcgaaatgagaaagggacaaatcaatatcactttcggttatagtaaaaaagtcctttttgatcatattggctttcttgtctcagacgaagaatatgagaagctgctttcacaggcaaaagagctcaactggccggtccaagaaggagaacgaagaacgtttctttcaacacctcttcgtttaagatttgaattacagcggcgtacagatgtcattgagaccgggaacgctacgcttcaagccatgacaattgctgttcctgatttgtcacagacacttaaagtggatcagctgctttcttctttgaatcagcccattcactggcaaaaaggagaacgcctctccttacttaacgtgatcatgactgattgcgatggattagatgcgaaagatccgaatggggttcatatcctgaaacagacgtagaaggacttactatttgtgaagaggatttcccttttgtacggtgctctccaatggtacaatcaatgtaaaaaattagaggtttgttatgaagatatttgctatccaattacagcacttagatgaaatcaatgaacgacaacaaatagagcgtctgaaaccctttgtttcacctgaaaagcgagctgcggctgagcgctttcgttttttaatcgacgcaagaaggaccttgttaggtgaggtgctggttcgtcaaaggatccatgatatgtacgatctgccttttgatgagatcgtttttgaaacagagggcaatggcaagcctgtcgtgcggcacattccttcttttcattttaatctttctcactctggtgattgggtcgtatgcgcaatagacgatgcacccgtaggtattgatattgaggagatcaaaccgattgatctagcgattgctaaacgatttttttcagcagatgagtatgaggatttactttcacaaccggcagaacggcaggaagcctacttctttcatttatggtcaatgaaggaggcctttatcaagctgactggaaagggattatcttatggtctttcatcctttacagcccgtctgtcagaggatggacaggcgacgttgacattacctgatcatgaagcgccctgctttgttcaaacatactcacttgatcctgcctaccaaatggcggtgtgtacaagaaagccttctgcggctgaacgagttgagatcctctcttgccgtgatgtgctgtctcgtctttaatatcgcccaatttgctgaaatgctgtctttaacaaatcgactccacgtgtcatttgttcttcttttacatgccaaatgtttaactgaagaatggggtctctttgataggtcgacagataatggcggtcgattgactgaatggaaacagatgcctttttcagctgctgaatgagctggttcatcggaattgaccgatcgagacgtacatgtgtatgagtagctggctcctcttctcctagttgataagcgatttgatcgcttttcaggcatgtcactagctgtttggatcggttgcgataggttgtctgcattctgtctcgatgccgttcaaacatcccgctttttaagtatatttctaaggctgcctgtgacagcatggagctgtcaatgtcaatgagccgtttgtgttcgctaaaaggtctaatcagctcctcaggtaaaacgaccgcacctgttcgaagtcctggaaagatgattttggagaagctttttaaataaatgaccttacccgcctgatcgtatgaatagattgggtctctttttgcatcgaattctaaatcggctatatagtcatcttcaacgatatagacgtcatatgtctctgcaagagctgcaatcgctcttttctcctgttttgacaagctcgttccaagcgggttttgaaatcttggcatcgtatagaaaaaacgaatctcctcttctcgaaagatgcgctccaattcctgaagatcaattcccttttccgtccgctgaatcccccgcacaggcagttgatttttttctaaatattgaaggtataggtgatagcctggctgttcgactagtatggtctgtttgccattcggaaaagggatggtgcttaaaatggataacgccagctgaataccagaagtcatgacgatttgttctggatttgcaaacacttgataatccattaatcgcttagaaatgactggcagcagcgatggtaatccgttggctgtgccgtaaataaacaagtcattttgatacaaatcgatggcttggttgatgcagtgctggaaatcgacatatggaaacacgacgggatcaggtgcagatgaagcaaaatcaatccatgcgctatcctgtttccccgctgactgttttgttttcacgacatagtatccgcttctttctacagaatacagcagatgttctcgttctaatgtatctagtgctttaatgactgtgcttttactcactgcatattgtgccgccaaatggcgaatggaagggatcttcatacccgcatgatattcaccagatgtcatcttctcttttaagctgagaacaagctgatcatttttcctcacaccgcttcctccttgtaccggtacagatatcatgttctcttattgtacaccttagatgatccgattacgatagaagaacagaaccggtcaattcatctgaagcatgcatgctcgtataaggagtcaaattgtggacatttcaaaacagaaagcgtatgctgccgcgataggctacgccacgatcattggtttttcatttttgtttgtcaaaattgcattagaatcagcaaatccaattgatttattggcacaccgctttacaatttcttttgcagccgcactattgctgtatccatttttaagaaagaagatccgcctctccattcaatggcgagatcttctctacatcgtgccgttttccttactttatcctgtgttgttttttgcttttcaagtatgggggctgatgtatacctcttcgtcagaggctggtattattcaggcaacgattcctattctaacaatggtgctggccgcgtggtttttaaaggaacgcgcaacatggatccaagtgctgtttaccattctttcggtgtgcggagtgatgcttctctttgtcatgaagggaattgatgtgaagcattcacacatgatcggctatatactgatattactttcagccttatcctccagtgcatacagtgtatttgcccgggtgattacacggcgcttccatgtgattgaactcactttcgtgatgacattctttggatttgtcttcttcaatgccgctgcgctcatccggcattcagtaaacggaacaacgctgcaatttttcagcccatttacacaaccatcctttgtatggtcaatgctctttttaggcattctttcttcacttctcacggcatatttatcaaactatgccctttctcagcttgaagcggcaaaggtcagcatctttaacaatttatctgcgtttattacagtcgccgctggggtcctcattttacatgaaacaatcgattggtatcatctcatcggaggtgtgctggtcattggcggagtgattggcgggaatgtagtcaagaagcggaattcataagaaaaagcggtccctttaaagaggaccgctttcttttaatgtttcattaattgtggtttgcctgcaaggtcgatcacatgtctcatctgttctgcaaaggactcgaggtgtgtgttgatatacatgtgccctccttcgaaattggtgcgttcgatggtttttgcccatggcagccagccgtttgcatcttgcatgcatttttcatcttgtgttccattgaataaataaacaggtgtttcgatgatggattgatctttgtgctggaaggtttccagcgcctgatagtctgcacgtaaggatggcgtaaagtaatccatcattggtttgttctctaataattcctttggtatcccgcccatttcggcaatatgctgaacaaatgcttcattcgataaatgggtcaggatctgtcgttttgtttgcggcggctgaatggctgaaatcacgactgctgcaggatcgattccttccttttctaacagctgcgtcagtctatacacgacaagtcctcccatggaatgtccgaacaggataaacgggcggttcaggttgcccgaaagcccttctttgtacagctcagccaatcggtcaatgctcgtttcgagcggcatgagattggttccatgacctggtggctctgctgctgttacttcggcagtgccttttagctgttcaaaaagcgggcggtacgaggcggaataaccacctgcaaaaggaaaacaaataagctgaataaggtctgattttttttcaaaggttttaaataaatgattcatacgttcttacccctttatcatcgtttgaagaattcgtgccagttcatccgcctgcggccttttcatcatggtgacatggtctcctttgatgtgataatacgagcacgatcctttcgtataagcctcccaatctgagaacttcttctggaaatcaatggcgtgatcactgctttgtacaatataaaacggcacatcgaatggttctttttctaattcaatggcttgtgacatgattgtattgtgcgtttgcatttgcaaatatttatctaaatactgatcattcataaattgatgaaccacttcatccttttctgcctctttgagtattctttgcttcacttcttggaagctcagcccttgtaatgcttctggctggataccgacgagatttcccattccaaggacaagtgcaagcatttttacttcttcttcgttcatatccgcatgaagcgcctgatcagcctcatctcttaacaccgggaccgtatctaaaatgatgagtcctttcggcgcttttcctgcatggcagagccgctgattcattccgtaggcaaggtgcccacccattgaatgccctgctagatagtcaacaccaggtcgatagaaggtctcaatggcttcaacaaatatagacacaagctctgtgtaatgaaggaattgcggttcttcatcctcatataagccaggagactgcaaggcgtacacagcgccttgctgtgtcatcagcttagccacatcgatatagcccatcaccgttccaccggcaggcggtgcaaagaaaatcctcggctcggctggatcgccttttttcagctcaatcacatagtcctttggagacctttcggcgtgctccccgtcctctggcattgcgtccacatgtgcggctagctgagccggtgctggatgcatgaaaatccattttggatcaacccgaatccccttttcttttaatttggctacggcttggatactcataattgaatcgccgcctaaatcaaagaatgagtcatgtatgcctacttgtttaacaccaagtacgtccttgaaagctgtgacaatttgttcctgcgtttcagtgactggtttgtcatctccctgagaatgagagatcgtttctgtcggctctggcagtgctttttgatcaacctttccgtttgttgtgactggcatttcgtccattacaataaagtaacttggaatcatgtagcctggcaggctttcctgtaaaaatgctttccaccctggatcaggattctctccatctgtgacaagataggccgccagccgttttgagctgccatacgttttggcgatgactgtacattcttttacttgtggatgtttgaggagagctgtctctatttctccacattcaatccggtagcctctaattttcacgaggttgtcttttcggccgagatattcaatggtgccatctgaacgccatgtaccaagatcacctgaacgatacagcctgtctccccctagttcagggaatggattgtctataaaccgttcctgcgtccgctctggatcatgaaggtagccttttgccagccctatgccgccgatgtaaatttctcctttgacgcctgctggcactggattgagcgcatcatctagtatgacgacagttgaattcgatactgggacaccaattggaactgaccttgctccctctggcatgtgcgtgacttgatgtgttgtggctagggtcgtgttttctgtaggaccgtaagcattgatgagtacaccctccatatgcggcagtgcttttcgtgcatgctcgctggacatcgcttctccgccaacgagtaatgtgcggtagcctgctacactttttggatcgtgctctaccagccgattgaataaagcggttggcagacagttggctgtcacttgatatgctttgatcagccgtgataattcatccatattcagtgcggcatatttcggaattagaatgagttgaccgccattcagcagcatgccccataactcaaatgtaaaggcatcaaaagcatagtttgagagctgaagcatcttatcatctggacctagtttcatataatttgtttctctcaccagacggacaactcctgcatgagggagcatgacgccttttggtgtacctgttgaacctgatgtgtagttgacataggctaactggtcttctccaatgattgattgttctctttgatacactgcatctgtttctggtaatggcttgtccatgtcaatctttgtacctgtaaagtctactagacgctctattaaatgagactgagtgatgatcacatcactttgcgtatcgcgaacaatgaggcggattcgcgcatctggatattctggtgacatcggaacatatgcagcaccagatttgacgatgcctagcactgagacaatcatgtcaaaggaacgatcaaaaagcatcggtacaagtgaacccggtccaactccttttgactgcaagtaagcagcaagctgtgttgccttctcatccagctcttgatacgtcatgtgctcttccaaataagacaaggcaatgcggtgcggatcacgctgcacctgttcttcaaacagctcttgaatggtccgttttggatatggcgtagccgtttggtttttcccaataatcatcgcagcctgttccgctttatccattaagcaataatcagaaaatgtacgttcaggctgagccgtcataccatctagcagatgaagataataattcatataccgatgaatggtctcttgatcaaataaatctgtattgtattcaacatggatggacagctgatctccgtgttcaaatacatgcaaggtgagatcaaatttagacactgtatgatgaaccatcacatgttcacttgtcagtcctttgagattgacatggagagaatctgttacataccccatggccacttggaaaataggtgatcgacttaaatctctatctaacgaaagatcatcgacaagcttatcaaatggataacgctgatgctcaaatgcttttaatgtcatctctttcacgttttccatgacatcagcaaacgtagctgatgtggagatatcctgtctcagcgcgagtgtattcacaaacattccaacaagcttctctgattgcttggcatcccgccctgcgatcggtgagccaatgatgatatctgtctgtccagacagcttgtgaagcaggacgtagtacgccgacagcatcgtcataaacagcgttgtgccctgctgcttggacaaagcctgcaaacgacggataagcgtatcttccaaaacgatttgctctgtagcgccgttaaatgtttgaactggcggacgaggacgatcaaacggcagctctaacaccggaagatcaccttgtaaatgatcgagccaataggcttggtctgcttgatgatgcgttacttgctcattttcccaatggacataatctgtccattcgatttccagcgctgggagctgcggcgattcatctgcaagaagcccatcatatgccacttctaattcctgaatgagcaggctgagcgaccatgcatctgaaatgatatggtgctgcgcgcaaagaagataaaattcttcattgcccatatctacaatcgtccactgcgcaagaggccctctttctaaatcataaatgcgattcgcttcttgctgaataagctgcttgagtcttctcgttcttgttttttcattaaataatgagaagttcgcaactgtgacggatggcggaaggtcttcacgtatcagttgaaccggcttgccgccaagcgattgaaaagttgcacgcagtgcttcatgacgtttcgttaagagaccgatcgcttttgttaacgcttgaatgtgcaattgtcctgtcagcttccaagcacctaatatattgtaatgatggctcttttctaatgtggataagaaccaaatacgcttctgagcatgtgacagctcatagcttgttcgcttttccagctttggaatattggcttcctgaacagccggtgcctctttgatgtcatccaccatttgcgccaaatgtgccaaatgcttgctttcaaataatatttttaaaggcgccttgattgaaaactcatgattgatccgtgaaatggtttgagtcgcctttaatgaatgtccgccaaggtcaaagaattgatcctctttgtacacacgatcaacgtctaaaatgtcctcccatatggcagcaagcaattgctctgttgtcgtttctggcaattgtttttcgagaggttgtccatttttgtgatgattcagcttaagggcttcatgatcaatagtgccatctagtttttttggtatttcttgtacttgctgaatatcccagtcaccttttgttccacctgcgatttcttcaacatgcacctctttgccaggctgaactgtgtaaaaaagctttttctcaaaagtcggtattggcgctggctgaagatacgctgcgatttctgggttggctccgtctaggccgataaatagatgcgcttcattcagccgagcacctagacagaatgaatggagaccttgcttctttccaatcaattgaaatcccttgcggacggtaagggctgcgccggtatgtccctttgacaaaccaagattatcccacatactgaagttcaaagagatcgcccgtcttccttcttgaaaggttagcgtgtgcgcaagcccatctaaaaagctgttggccgcagagtaagccccgaatgttgtgccgccaaaaaagccattcactgatccaaaaaagacgagtggtactgccgggtcatgcttgaaggcttcctgcaggacaaacgctccgtctgctttccctgacagttccttcgtaaaatcctcttctgacgtatgcgccaatgtatacttattcgtttgctgaaaatgctcagacacattgcccgctccagctaaatgcagcacgcccctgatggattgcccaaaatgtttttctgctttgtaaatcgcctgctcgacgtcagttaaatcggtcacatctgcttgtacatagatgacatcaccgaggtcttttagctgtgagaacgcttctttcttttcaatgttggcttccagagaagtccttccaatcaatacaagctttaggccaaattgaagcatctgcttagacagttcaaatccaataccgccaagtcctccagtcagcaaataaagtccttcatattctaaaaatccttctgtttgaggtgcttgcatcatatcgactttttccagctttggtacaagcctgtgcccttttcggtatgctacctctgcttttatatgaatcgccgacaactcatcagcaatgttctttgcatcctgttccacttgctccgcttcaatatctatatgggacacctctgctccatcccattcttgcgggatggtttttaacaaaccaacgagcgacgttttctccacatgaagatcgtcatcagggcttacaaattgaccaccctttgtcaccacaacaagccggactggctctttgttttcttgcctccatgcttgatacaagtacaaaatagattgattggacctcgcatgcacttctgtgaactgcgcaggctcaacgatggcttctttgtctgtcacattccacaggtggagtatacaccctgtctttaattcatctgcttcaagtgctgcaacgagcctgacataatcccccttgattctcgggttcatctggtacatccctttggacagacgcaaaaattcatgtccttttttcacagaaacatagggttgatttctttgttccaattgggcgtaaagtgattggtaaagccctttttcatcctcgaaaacgagtacatgatcagcagcaggctggtacggaccaatttgctcctttgcccaagtgcgtttgaaaaaccaatctggcagtgtttgttcattttcagaagcaaggtccagtgccctttcaatgtcacggaataccccttcttttagcgccgcacctaactgagcacgttggatctttccactttctgttttcggaaattggttcttttccactggaatgatgtgatcaggctctatgccaattttacgaatgatggctgctctaatctgctgaatcatcgtgatttgttcctctagcgaatccttttgtgtgacaaagaagacggcaagtgtgtcgttgcttgattcaggattgtaaatgccgtacgcagcggcaaaggtgacttctaccccgtccacctcttccacaactgcttcaatttcgtaattcaaatagttggctccgttgatgacgatgatgtccttttctcgacctgtcagaacaagacgcccttcgtgaataaatcctaaatctcccgtgtgaaaccagccgttttccgcaaatacctcttgattggcttcctcattttgatgatagcccatcataatcgtcggactcttcacctgcaagcgcccgacctgatcttctggcagcacatgatgatgctcgtctacaatccgaatccatacagacggaatcggtgcgccgacttctgtaaatgtcattttgtgcggatgatcttctgccacgtattggatctcacctgttaacgaggtctgatcaatcgtcagctgtccatcctgatcatcatgccgcatgaatttctttgattgaacaatggctgaggatgtttcagacatgccgtacgccggcaccatcgcatgacggcttaatccgtgctgacccatcatatgcatgaagcgctgcgtcacttttggtacaactgcttcggctgcattcatgatataagtcagtgtagagagatcccagctccccttgcgaatgccgtcctcatattcattcatcatcgcaaaagcaaaattcggtgcccatgtccttgtgacgccgtatgtttctacccaatctagccacaccatcggccgttcgataaattgatcaatggatggactaatctgctggcagccaaagtagacgtcatgcacatgaaacatgacaatgcctcctacatgatcaagcggcatccagttaagcgacacatcctcatgcgtaaagccatttgtctgctcaaaggagatgattctagataaaatgctttgatggttgtgacggatacactttggcacacccgtacttcctgaagagagcagctgaagcacaggctcatctggctctggctcataatgctgttcatccggctcacacgagagcaatgtttcgattgttaaaataggcatgtcttttgcttcaaatgcctcacgcagcccagcaatgtcctcagtacttgcttcattcgtaataatgaacggttcattttgaagctgaaacacacctttcagcttgttcacagcttgattcgtttcatcataaacaggcggtacagagactggggtcggaatgatgccaccgagaatacagccccaaaacacagtgatgaaatcttgatgatctttcaattgaagtaacacttgatcaccgtttgtcagccctgctttccttaaaccagacagaatccgttctgcatttgtgagtaactcaggataggtttgggtcaacgtgcgcccgccttctttgatataggttaccccgcgttcaggtgacataaaggctgatcgaatcaacacctctgtcagtgtgacaggtgtgcctggttttttgatgacatccccgccatacactagtgcgggcggcttttcatgggcagatgcttgcactatttcgccctcttcatccttcgagatcgatacgttcccttgcgcacgctgccgattaggaaatagatcatctaggtgataaggcgtttgtttttctgtctggctttcaatgagagtggccgcttcattcactccatctatggctttcgtccgttcttctatctttctcaaactctcttcatccatgatgtcgattgaaagcagcgcttctgtatcgactgctccactttctgcccttggcaaggaaggcaataagacgagagcggctggcacttcatcagggtgaagcacgcctgtcatcagatcctctcttgtcagcgaagggtccttcgcctgtgcaaataacacaagcgagaggctgccttcttcatttttcttcgggatgaatgcacattcctttagcggaaaatgaagcatcatgacctgttctaatgctttgagatcgattcgttttccgttgattctgacgatatgatttgctgcatggcctttccttctactcattaacatcgttcttctcctcctacacccaatccaaaatctgaatcttgtttttttcagtccaaacgccgacatcccctgtcggatagaggtattcgcctgtttgatgtttgaatggatgcggaattttatgcgtctccatccaatcggcaagctctccgcaaagtgccttgataccctctgcaccgataaaaatatctccaggaaatcctactggcatgagctgatgctcttcgctcaggacatagatttctgtctcacacgaaggatcatgcacacctgagtagacctcttcttgatctggatacagcacgctgacttgtgcatttttcgcccaatcggtgatcatccgctctttttcttcatttgtcacgatcgtgaaggaagagagtggtgtctccacttgttctgtcatggcttcaagtgtatggaccagctgctgcatcagtgattgtatttgtttctctgtatattgattgaagcggtatgtgacccgaagctccagcgtatctcccgggacagccacaagggtcaggtcatagtttgtttcttcatgactggctatgtctaagatccgtacaccatatggttctacagattcaatcggatagttttcaaacacgacaatgctgttaaacaatgattctccattcggaatttgggtcatctgctgaatatctggcagtacggtatactcgaattctctcatgtgaaaaactgtttcctgcgtctctgtcagcagctcggcaatggtcttatctcgtgtgatcggcaaacggagcggcaaggtgttaataaagagacctgtcatgctttcaacctctggtaagtccgccggccggccagatactgtgacaccgaacacaacatcctctgagcctgaatgaaggtgcaagagcagaccccacgccgcctgaagcagtgtgctcatcgtgaccttctgtctccctgtcattttctccagcttctgctgcatgtcaggcgtcagtttgatactaatttgatcaatacctgctcctttttccgaagcttgctctccgtctcctggtagtggtgtggcttcctctacccctgacatgtaatgtttccagaattcttgcgccttcttttgatcctgcttttgcagccactcaataaaatctttatatggacgtacagcaggaaggttcatctctcgttcatccacaagcgagcgatatattgaaaaggattcctcaatcaagccgaacaggctccagccatcaattaaaatatgatgaaagctaaaaacaaacgtgcaagttttctcatcacgatggaatagagcgatacgaatgagcggttcagccgcatcttctaattcgaaatcctttgaacgatcggtttgtaaatactgctcaatggttttcttctgatccatttcactcaggcggcgcacatcgtgttgaatgaggtgaatgactccttctgattgaatcaattggacaggctcctttagcccctcccaagcaaatcttgtccgtaaaatcgaatgacgttctacaagcagattccatgctttttcataggctccaccgtccgttaaaccttcgagcgtcatatgcacctgaccaaaatacgcctgtgacgcttgatctaacagtgcatgaaacagcatcccttgctgcatcggagatagtggatacacatctaccacattgtctgggagctcatctatttgcttttgcgtcatctggaccattggaaaatcagatggcgtaaagccgccttttgtctctacacaatgcgtcagaatatcctccattttttctttaaatcggtcaggtaattgacgcacctcttcctcctgaagcagttcacgattgatcataaaattcatctgaagctgcccattgacaacgtatccgtacacatcgatcaaatgctgtctttctgcttttggatcatgtacatgcccatttcgctcatctgctatatacagatttgcctcaccgtctatttgatctaactgtccaaggtaattaaagctcacctgtggcgctgccgttttaagtaaacgcgctgctgtcatgtattggagtaagccatagccgatccccttttgcggcacagctcttaaggtttctttgacatctttgatttgcctctcaacatcggtttgaataaaaggaataaaaataggataagagcttgtaaaccagccgactgtccgtgacaaacccatctgttcaaataaatcttcgcgtccgtgcccttctaacgtgatcagtaatgactttccaacagcttgcgcgagccctgataagagtaaatcgttcacttctgttcggtacgcttgtgatgcgtgccttagtaaaatgtctgtttgatccttcgtcaattgaacagtcaggatctctgcatgttcttctatattgaaaagcgcaggtgtttgaaaaggagaaccttcttcctcttgatcgatgattttttgccaaaaaggaacctgctcttgtaattgatcagtttgtgcaaattcatagagtgcctctgcccactgctgataggaagcggttttcttagcaagcgtgatctcctgccctgccgcagcctgcttcaacccatttaagatatcttcctgtatgatgcgccacgatattccatccatcacaagatggtgggctgcgatgaagagttcagacgtgcgatcacttgtctgaaaaagaataaatttgatcaattctcctctctctaacgacagtgttccttgacaagcacttgtctccatacggatttgctctatcgcttcctcgtgagaaacatccgtcaaatcaaagaatgtgacacaagggatgatgccgggcgcacgaatggtttgaatccatgtgccgtctgcttcttttgtataaatggctctcagcatatcgtgatgatcgacaagttttgaaagaacttgtgttaactgctcgggttgtatagattgcttgatttcaatatgagctgatagattccaataatcttggtttgtcatcgattgctcaaggaaccaagattggattggaagcagacgtacatctcccgtaacaggtgattgatcataagacacagatacatctgcttttttcatcgcgcgtgccagctgtgaaatggtctgtttttcaaatacatctctcggctgtatgatgtagccttcctgtgctaggcgtgccaccatttgtatgacaataatagaatctccgccaagctcaaagtagttatcatgaacaccgattgaaggagtgccaagaagctgagtccacaccttttcaagtacttgttcttcctcactgagtgcctgatctgctggtttgtctgcttcttcctgtctccacactggcggcgggagacgcttttgatctaccttgccatttggcgtgagcggcagttcctcgagctctatgaataggctcggtaccatataatctggcagtcgatcttttaacttgcggcgaaggtcttgctgggtccatgcacctttttggacaaagtaaccgatgaggcgcttatgaccactctcatgctgatgcggaatgaccgcacattctatgatgtcttcaacactcagcatagcggcttcaatttcgccgcattcgacgcgatgtccgcgtattttcacttgatgatcgattcttccaaggcagtcgatgatgccatttgggagccagcggcccatatcacctgttttatataaacgctctcctttatggaaaggatgcgggataaatgattgcgatgttttttcttcatctccaagataacctagtgccagccctgttccaccaacataaatctctccaatgacaccttgcggaaccggctgcagctggtcgtctaatacataggcttgtgaataagcaattggctgaccgatagggacggtcgtctgctcttcgtctaatgagcgaatgtgatacacacaagagaacgtcgtattttcagttggtccatagccgtttaaaagcccttcaggtaaatatggcagtgccttgcgaatatgagctgctgatagcgcatcaccaccgaccaacaatgcatcgaatccagataaagcttctggatgttcctccgtcaatcggttgaacagcggcactgtcagaaatcctgttgtgatcttgtatgacgtcagcgtgtcagccagtttatccattgataaaagtgtatttcgatcggtaagaatcagccttcccccgtttagaagagctccccatatttcatacgtaaaggcatcaaaggagaagctggccatttgtaaaatgcgcgtatgttcatcaaaagtgacatagtttgtttcacagacaagccggatgactgcttgatgcggaatcaaaaccccttttggctgtccagttgaccctgaagtgtaattgatataagcgagtccatcaggttttagggcagcaggtataagttctgcttctgataaaaattcttcatatccttcatcaagacaaatgagttcggtttgactgatggacacctttttcagccattcattttttgtcagtaacagctgaatacctgtatctctcagcataaaatcaatgcgtgcatctggatattcaggatcaatcggcacataggcgcctcctgctttcacaatcgccagcaccccaagaatcatttcaggcgacctgtccatgagcagtcctactggttcatgcggcgtcacacctcgctgctgaagagaagccgccagccggtcgactttctcttgtaacacatgatacgtccactgctcttccccgaattcgagagcgatggcatcaggtgactttctcacttgcgcttcaaaccgctccgtaatgagaagcgggcctgccggctgatccattttgccgctccattcatagagcagctgatgcttctctttttctggcaggtaattcatttgtttgatcggctgtgctggattttcacaaatacgcccaagcagctgctcgtagtaccgaaggaaccggtccatcgtttcgtcagaaaataagttcacatcatactccagttttaattgaagaccctccgctccttcaaagacaaacagagatagatcgaatttggcggtatcgttatcttcaatagctaaaacagatgtcgcctcccccattggagaagcctcaagcggcagattttgcaaaacgaacatgacctgaaacagcggctgtttgccagcctcacgtacaatattcagctcatctacgaccatctcaaacggcacatcctgatgcgcataggcgcccattgttgtttctttcacccgttctaatagatcagtgaaagcaggattcccgctatgatcgatccgaagtgccagcgtattgacgaaaaagccgatgagttgttccatctccgtccgatttctaccagcaatgactgacccaatcacaaactcatcctgtgaagacaaacggtgcagcagtgttgaaaaggaggtcagcagcgtcatataaagggtactgtcagtttttttagaaagctcagccagctgatctgacagcgacttcgacaggtggtattttttcgtttttcctttgtaggattgaacagctggccgcgggtagtcatacggcaaaaccaaatcttctacagggactgcaaattgctccttccaataggaaagctgcttctccagcgtctctccagtcaaatactccttctgccatagggcgtaatccgcatattgaatcggcaaaggcgatagattaggctcccgcctgtcgatcattgctgtataccattcagacaactctcttgcggcaatcccaaccgaccagccatctgacacaatgtggtgaatggacatcagcagcaaatgatctctttctgacagccgaatgagttttacacgaaagagcggatcatgctctaagcggaaaggtgtgcttgcctctctttttgcccattcagccgctttttgttctttttcttcctgcgacgtcaaatctgatagatccaccacttcaagctctggaaggatcatatgctcatggatcatctgcaccggttcatcgccgttcatagtaaaggacgttctaagcgactcatgcctttgcaccatttgctgaagactgcgctgaagtaccttcacatctaaagatccattcacccgaaaggaaattgtattattgtaaaatggcagatcaggctgtaattgatagagaaaccactgtctttgctgggcataggacatcggaatctcctggccctttgccattttccgtacctgtaccgcttcatccacttttgcatgcgaatcgatccatgccgctaattccccaagtctcgtatgctcgaaaagaacagcgagcggcacatcaaatcccattctttgtctcaccgctgacagcatttgcgttgccttgagcgaatgacctccgagtagaaagaaatgatcaccacagctgacatttgagacttcaagcagttcggaccaaatgcttgccaaaagtttctccgtccccgtttgaggcgctctgtcttctgcatcctgtccactttcctcaatgagtgctttgaaatacgcttcatccggcatgccatcctctgattctttccagtattcctcaggaaatagatggacggaatattcaccagatagatgagtctgcaaacatgtataaatggactgatacagccgttcttcaatggcttttgttttgtcggttttgtaaaagacatacacggctttctctgttcggctctccgcatgaagcatctcttgaatgtcctgcttcgaccgatctaatcccatataaatgagaggtgcatctgtcattaaacatgccagcatcgtctggaagcccgcccgcttcggaatcggaagatagcctctttcttttaacatacctttgatcatcgaaccctcgctcatgccaatctcatcccacatgctaaagctaaagcagtatggcttcacggtagatgtcagcctctgataatgagcaaattgttcaacgaactcattggcagcagagtaagcgcctacggtcatcccgcccttcaatgttcgtgctgatgagctggaaataaataagacgttcttccgtttagaagccgcttcatgaagcgcaatcgtgccatatacctttgcttcgtacatcgcatgtaaggacacagacgtcatgtcagcaagcagctcttcttgaatgatgccagcgaaatgaatcacgccatgcagcctttttccatgggccacctcttgtcttgagataagggcttcaagggcttttgcatccgtcaagtccacttcttcataatgaacagtgccgccgcgtttttccgcttgtttctcaagtgaggtcaatacgtcttgctgctccacagataaagctactcgtgcctttcttccaagcagaacaagatgcgcttgataggacgtcagaagatgttcacttagcatccgtcctattccgccaagcccgcctgtcatcacgtaaagcccggttgattcaaatggtggtgtcttcctcttttgctctctttctagatgaatcggcgttaaaagaggaatataacgaacaccttcgcggtaagcagcaatatgacagcttgtgtcctgtgtaagctctgtcatgatcgctgatgcatgggaacggtcagccgattctgtcagagaaaaatcaagacaccgcaccttgagaaacggccactcatgctgtacagctgtcatcaatcctgctgtcgttgctttttccacatgatgtgtttgatcttctggcagattcatcgcatgagcggagacaaaagtgatctctacaggttcctcataggcggcaatcgcttttgttgtatataatgcactcatgctgccaattttctgcgcttccttcgccattgctgcttgaagtgtgtcttccttgtttgtgtagttccaaaggtgaatgatttgtttcaccgaaacgccatacgaacggagcgcctcaaagagttgttcgtagtctgacggccgattcgggtggatgatgaagtgagtatgtgtgagttgtgtgaatgcttgacccggttcaaccgtaatataggtttgttcattgtttgatagggatttcaattgatctgccagacctaatgcatccgcaaagatcactgtatcccctgctgtttgcttttcagttttatgaagcggagcgggtgtccacttcttttgataactccaatcaggcaaggtgtgttcattttcaagtctgatgtccagttccttaatgatttcgtcaaattctccttcctgccaccttgtcttgagctgtgccctttctatttttccagagcttgttttcggaaaggcatgcttttggacaggaataacccttggtgcagaaagacccatttttgttgcaatatgggttttgatgtgctggctagccctcatgatataagcaggctcatacagcttcggtgtaaaaaagagaatcagttcatcggatgcagatgcctccattcgcacggagcaagcagccacaaagcttgtttctacgccgggtacttcctctgccatggcttcaatttcatagttgtgataatttttcccgttgatgatgatcatgtctttttccctaccagttaatgtcagctttccttcatgcagaaaacctaaatcacccgtgtggaaccagccctctgtttgaaaaacctcttcattcgcttcgtcattcttgtaatagcccttcattgtcgtcggccctttgatttgcacgctgccaatatgatcttcaggaagaagctcatgctcatggttgacgatacgaatcgtgatacctggaatcggtttccccaactctgtaaagctgacggttccagtgtcgcgtgcatccgctggtcttagctgctctgtcagcgatgtttcctcaaaggtcagaaccccgctgttttcatctccccgctcaatcgcaaaagagaagacaacggctgatgagatttctgacatgccgaaagccggtctgatgacgtctccttttaagccgtgcggagcgagcaagtgtaaaaaccggtggatcgtcttcggtacgaccgcttctgccccattgatcatgcacgacatggaagaaagatcccaagaccctgaagagatttctttctcataatcattgatcatcgcaaatgcgaagttaggtgcccatgtcttcgttgcacgataacggtccatccagtcaagccagcgcagcggctgagcgatgaagtcatctgttcttgcccgaatctgctcacagcctgtgtacacattgacaagatggaacatgacaatgccgccaatatgatctaatggcatccagtctaacgagacatcttcttgtgtaaacccattggctgcaaccgttcctttgacattcgccaacacacttctatgagaatgctctacgcatttgggcatccccgtacttccagacgttaagataaaaaagacggaatcatcaggcgtgactggatgtgcttctagatctctttctaaagtaagcattggttcaacggctgcaacacgtaattgatctgtatgccacagtaaagctaagccttgcacctcatcaatcagcgaatcatccgtgagaatgagcggatgctccagcaggttccaagcgtgatgaagcttcttcactgaggcattcatttcccgataggtcggggctgccgatacaagtgttgggacaaatccgcctaatacacatgcccaaaaagccgtgaccatcgcatgattcgatgaaaattgaaagaacacaggatctcccggctcaaggcctagtgctcttaaacccgtcagcacccgctcggcatcctccttcaactgcgcgtaggattgcgtgagctcattttcactattgatgatataagtcagcccatttgttgatttggctgcctcagttagagcgtcctgcaaggtttgagctcctgcacgaacatctatatcccctccataggaaatggctgggggcatgtctgctaaaacaggtgaagccatttgcgtttgtatccattcagctgcggcctcctgctccatgtgatggtctagaaataaatgagagaggtgatatggccgaggtcgaatggttttttcacgagaaaaaacagcgaagcgttcgatttcgttggtttgtaaaatggtattctgtacatcttgtaaaatcgtatccattgattcatgtacattcgattgattgatggttgatggtttcatatgagttccttcccttttttgtcaggcagggctgccagtgtgcacccctgcctcatctaaagtttacaagactgtttctctatttttatgatggactatttctttaatgagctgtgcatttcggacggcacattctttgtttttgaacatgtcggcgtgctgaccaaagccttgaaattctcgataagcgccggtcgtcgcagtttcccatttatccatccattctggtatcgcaatatgctcttcggattggataaagtcaatgtctgcgtgtatctctccttggttcacccccttaacaaaagcttcatagtaagccctcgttttttgagcaagctcgtcttgaatgagctccgcttgggcaagttcactttgcttcgactgatggacgatcgcggcgatatcgtcatcaatggatcgtccttctaaatcactttctcctattttcttatacgaatcgatcatgatgaccttttcgacggtccgccctgcttgttcgagcgattgaacaagctcaaatgctaggtagcacccgccagagtaacccatcaaagtcagtggtccttcaggctgaaggtgctggatatgctgaacgtattgcgtgattcggtgatcagcttcaataaagtcaaaggcgataaaacgaataccatcaagcgtttttgcggcttcctgatagataaagccatagcccggtaatggtggtagagcaaagactgttggcgtttgagattcattgaatacaagatagcctgcagcttcctgatcctgctgttgaatataacggctgactgcttcaatggtaggtgtctcaaacagcaagtgaataggcacttgaacatcaaattcctttgtcaccttagataaaagcgacatcgcttttaatgaatgcccgccaagctcaaagaaatggtcatctgtgctgatatcttctctttcaagcacttcccgccacatcacaagcagcttttgttctacctcatttaccggaagcttcacatgacggtttccttgaggcacctctggctttggcagctgacgtttatcaacctttccatttggcgtaagtggcattttctcaagtctgatcagttcatgaggctgcatgtaagccggaagtttttcctttagccctgacctgatcacattgagtttatccttccactcctcctcacacgtcatataggcaagcagccttgtatgctgcgtgttatgctgatcagctataagggccgcttgttttacacctggatgcatgagaaggtgggcttcaatttctgtcagctcaattcgatgaccgcgaattttcacctgatcatccactctgcccgcatactcaatcaaaccgtccgctcgaaaataagccaagtctcctgtacgatacagcctttctcccgcagcgaatggatgcgtgataaaggcttgtttcgtcagatcaggacgattcaaatacccctttgcaagccctttgccgctcagacaaagctctccgaccattccaatcggctgaagctgtccgtgctgactcaatatataagcacccgtctggttgagcggctttccgattggaatcgaacgcgcttccatcggcagagcctcatcgactggataataagtggcgaatactgttgattcggttgggccgtagacattgatgagtctgcctttccccataacagcaaaggctttcctcacatgctggactgatgcccgctctccaccaaacagcaccttgcgcacactgcgcatccagtcggtttcttcatcaacgaggagattaaataatgctgtcggaacaaacatgacagaaatattttcccttttaatcaatcccgtcagctcgcccatgtttaaaatggtctcttttttcggcaagacaagcttcgctccgtttaaaagtgcgccatacacatcaaatgtaaagccatcaaatacgctgttggatagtgacagcagtgtatctgtttctgaaatggttaagtagtttgtatttttgaccacccgggcaatattcgaatgggtcgtcataatgccttttggctgacctgttgtaccagacgtatacatgatgtaagccgtatcgtgtaagcctgcttcaagcggcagattctctgagctcatcagtgaaatttcttgatcatctgcaaacagatacgttccatcaaacgcaagtgccttcacttgaccgataaaggatgagtgagtcagtagatgcgttgctgcgctgtctttaagcatgtattgaatgcggctttctggataatcgggatcaattggcacatagattgcacctgcttttaagacagcaagcagactgacaatcagttcaggtgtgcggcccgctaaaatggcgatgaccgtttgatgcgtgaccccatttttttgcaaatgtcttgccaatcggttggcttgttcattcagctccgcatatgtcatcgtgtgctcacctgctgataatgcgaccgcattcggctgtttgcggacattatgctcaaaccatttcgacaaatacagctggtcatgctcaagctcgggcgcattccattcctcaagaatcagctgcttttcctgttttgtgacaagtgtaagtgtatgaaccgattgatcaggatgtttgaccgcctccttcatcaatagactcagctgttcctttaaccgttgaacaaattgaggatcaaatgctttttgattaaaggccagcttcaattgcaattgttctcctggtgatgccagcaaattgagatcatagttcgatttttcatacacattcatgttttccacagtaaatcctaaccgctcctcttgctcttccttctttgcggctgggacattttcaaacacgacaatatgatccatgagtggctgatgacctgtctttgcctgaatatcataaattggaatgtattggtgcggctcggccgcaagagactgctgctgcgttactgacagaagagaacggaatgtcatgtcatctgtcagctgaattcttcttgggatgacattaatgaacaagccaaccattctgtcaacaccagccaaatctgccggacgccccgacacaaccgtgccaaacagcacatcatttgaacgctgatatctgctcaataaaattgaccagactgattgaaggacactgcttaacgtcgcattttgctggaacgctaactctgataaagcagccgtttctcccttgctcatcgaccattccaattcgcctaattcgtgttcattcgtttgctttctctgttctttaaaggtagattgtccatcaaacccagctaaagattgctgccagtattgaagtgatgcttgtttatcttgtttttccagccattgaatatattctttgtacggtttaaccggttccagcttgtaagggatatcatgcaaaagggcatgataaatcgcaaatagctcctgcaccacaagcccaaagcaccagccatcaagaaggatatggtgatagctccatatccagcgatagctggcagggcccgtttggaaaacagttgcccgcatgagcgcatccttcgaaaggtcaaatcctctcagctgatcctgttgtttaaatgtctcaatacgtacaagctgttcatcttcagaaagcttctgcatgtccaccacatcaagcgtaaaaggacgtttcttcagtacaacttggacagggcgcttcactttttcgtggagaaatacggtacgaaaaatatcgtaccgctccacgatgacattcatgcttttctcaagtaagtcatgacgcagtgtgccttttacgttcatatccatttgctctacataaaagcccttttcttggtgatggagggtatgaaacagcatgccttcttgcatcggtgacagataatacatgtcttgaacttgatcccttttaaatgaactcatctatttcatcctcccttcccgtttttatgtctgatctcatgttgctaagtcaatttctcctcaagcatgtcaaaaatgtcatccatttcatccatttcaaggtcaccagcagagaaatcacttggcgtaaattctcgttcgtgctgcgctaaacaatgagtcatgatggattggattttttctttcaacaatgccatgaactgctgtatcgtttgttcctcatattcatctgtacaataggaacacgacatcatgaatcgtttgtgttgaacaagaccactgagattcagcttatagacagcttctgaatcagggcttgcttgtcgtcccatatcataggcggacgttctaaagagttctgtcgtcacttcttgatcaatctgccccagatagttcaagctgatttcaggttgtacatgctgtcctgacgattcagtggctgtgaggtattttaaaatcccgtagccgatccctttattcgggacacgccgcagcatctctttcgttcctttaatagtctcagctatggtctgatccggctttgctttcagtacgactggatacatactcgtaaaccatccaaccgtgcgggagacatccagtcctgataaaatatcctctcttccatgaccttcaagctgcacatgtacacgggactcacctgtccactcctgaacagcaagaccgagcgcacatagaagaatatcgttcatttccgttgtgtacggtagatgaatgtcggtcaaaagatgctcggtttcggactctgaaagctgcatctgtactgcctttgtttgcgcaacttttcttttcgttacttcacgatcaacaggtaaagtggtgattggcgtcctgtcaatctcattccagtactcactttggctttttaacggcttggactgtgcgtatcgttcgatcgcctctgcccattctttaaaggagtgggttttgggcggcaggacgagcgtttgtccttgggctgcctgttgataaagagacataaagtcctctagtaaaattcggcatgagacaccatcaatgacaagatggtgtgtcacgatgagtaagtgatcgccatcttttgcacggaaacagatcactttcatgagcggacctgtttcgaggttcaactgacgctgatactcgttggcataggtggaaatggcttttttcacgacgttctctttagagacatcatgagaaattatcgcaatcggctctgtaagctcccgctggttgtattgcaggatgctgccattttcttgcctgtataccatacgcagtgcatcatgatgtgaaagtaatttctgcatcacttgttctgtcatcgaaaggtcaaacccatttggcgcatgaagcatcatcgagagattccaatggtgctgacttgtaaagttccgttcaaagaaccagcgctgaatcggtgttaacatgacttctccttcgacaggtgattggtcggctgttagttgatcagcttcttcgatatatggacgcagctcggcaatggttggatactggaataataacttcatatcaagcttccagcccgcttgtgtgagtctgcttgccatttggatgcctttaatcgaatctccgccaaggaagaagaagtgatcgtgaatgccgacttggctgacgccaagcacgtcttcccaaataccgcatagaagtgtttccacttcatctcttggcgcttcgtatgccgtttggttcgcttccatatctggtgctggcaatgcctttagatcgactttgccatttgccgtcatcggcaggtggtctagcttgatgatccatgaagggaccatatagtctggcaacgttcgttttagactttcctttaggtcagtcgtttcttcatctgtgatgacatatgcggcaagcgcgtcttgatcgctggcatctttgaccgttgtcacacgaattaacaggtacgttttgtcttgtttagttttcaaagatcatatttaaaaaatggagcgggtgatgagaatcgaactcacgacatcagcttggaaggctgaggttttaccactaaactacacccgcgtgatttgtattggcgcgcccgagaggagtcgaacccctaaccttttgatccgtagtcaaacgctctatccaattgagctacgggcgcttaatcaggcgacttaattatcttaacatatcgtttttatcaagtcaacatctttttaaaatttgtttgccgcatgtgtttgaatgtctttgtttcaaatacgtcatcagcgacgaataaaaatataccatggatcatataaaagggtcaatacatttttctaaaaaagtttcatgttttttaagaagtggttttttcttagataactagagatgcgatagccctattttcttctctttcttcataattctaatgattcttaaataaaatctttctaaatccaaaggaggacaaaacatggtcacatagaatttttatttattggaaaattcttaaaattttccaagcaattaaagggggtaggagatgatgaaaaagttcgtcgcttttcaaatcatgatcgctttggtgataggagctcttatcggccatttctttcctgacttcgggatggccctcaggccaattggggatggattcatcagattgattaaaatgatcgttgttcctatcgttttctctaccattgttattggtgcagctggcagtggtggtatgaagaaaatgggcagcctaggattaaagacgatcatttggtttgaggttatcacaaccatcgttctaggaattggtctattgctggctaatgttcttaaaccaggcgttggccttgatttctctaaattagctaagaaagatattggtgaattagacggttatacgcaaaaagtcgtcgactttaaacaaatggtactcgatatcattccaacgaatatcgtcgatgtcatggctcaaaatgatttacttgctgtcattttcttcgccatattatttggtgtagccgcaagcggtatcggtaaggcatccgctcctgttctcaacttctttgaatcagtggcacaaattatgtttaagctaacgcagatggtcatggtgacagcacctattggagtgcttgcattaatggctgcttctgttggtcaatatggcattgtgttattaatcccgatgatgaagcttgttgggactgtatttttaggattattcattattctctttgctttgttccctctagtcgcactgatcttccgttttaactacttcgaagttttaaaaatgatttgggatttgttcttggttgccttctctactacaagtacagaaactgtccttcctcagcttatgtcaagaatggaaaaatacggatgtccgaaaagaattgtctcctttgtcattccatctggtctttctctcaattgtgatggctccagtttatatttatcggtttcctgtgtgttccttgcacaagcgtttggtgtcgacatgagtttgtcacagcagcttttgatgatgcttgttcttgtgttaacgagtaaagggattgcagcggtgccatccggttcactcgtcgttcttttggcaaccgctcatgcagtaggtcttccagcagaaggcgtcgccattatcgccggagttgatcgaattatggatatggcacgaactggtgtgaacgttccaggtcatgccgttgcatgtattgtcgtatcgaaatgggagaaagtattccgtgagtctgcttgggaagttccaaaagcaggtgaagaaaccacaggaatgtagtgttatatgaaggaaagggcttcccctttccttttcttatgataaaaatgcttgctttaggaccgctttgccttgaggttgcagctgcacttctgcatatgcgccattaatcagcgtcatttgcggccgtacatgtccacaatctatatcgtaaaaaatagggatttgtaattccttttgtaattcttcatatacatcctgatactgatacccttccacaggcacatctactgcacttcgcccaaacataatacctgaacagtgatcaaaccatcctgctagttttaattgaacgagcgatctcttcacgcttgcagcatttaattcgcagttttcaaagtaccagagaattggttcatcctttaagaatgttttttgaaaagctttgacgtctccaaaaggcgtccccgctaagtggcgaatgacatcaatacagccgcccatcagtctcccctttaacatcttttcttgtcgatcaaccgtatgccatgcggtcggttctgttaaatgaaaaacatgttcaatcggattgtcaaactgccattccttttgatacattgatgaagaatattggctgatgtccatttccccttttgttgaaagtacttcttcccacatgacagtcgtttgatcaagctcttctccctgaagatctactagattcggcccatgcgcagtagcaatacctgttttgaatgtcaacgcgagcaggagagcactagtatctgaataaccaagaatccactttttttgcatcgatgagaaatcaaggtgctctagcacttccattaaaagctgccctccccatggcgggatgatatgatcaatctcatcacatgtcatcatgtactgaagctcctttgctcgttctacggcaggggcagatttcgccttttcctgcttccagaccgtctctccacatatgacatcatagcctctttttttcattcgttcgcatgagagctgaaacatgtcatgcaatgatggctgtacatctgaggaaggtgctgtgacaccaatcgtttgtcctttttgtaattgtggaaattgtatcatcctagttccctccatcctctctcaatctctcatttataaagaagatgcccctattacaagggacatcttcttttattccttttgacgcagtacagtatagacacctgcaaagatacatagaatgccaatgaatgagcgtaatcccatttcttctcccaaaagcatccagcccagaacggcacctacgatcggttgaaagaaaaagaacaaaccgccgcttgaggcatccattaattgaagccctctattccataaaaagaatgctagagctgttgagatgatgcctagatatagaataccgccccaaatctcaggccttgctacctgttccacatctaggtgaggtaaacgaaataatacaggcggtgttaaaacaatgaatgcaatgatgatcgcatatgtggttgtcaccacctgagggtactttcctggaacacgtttgagcaaaacagacatcagcgcccatgttaaagcagcgaagatcaatgaaagaccaccaacaaattcatctgtctgtactgcaactggtccaatcatgagccatacacctgctgtagcaagcaggatggatgcgcactttcgaacagtcatggcttcttttaatagaaagaaagcaaacagcaccataaacgcaggagttgcagatgtaataacagcccccatttgtgcagaggtatacatcgtccctatttcttgggtcacgattgaaaggaaatttccgatcagcccaatcaacaccataagcgggatatcttttttatctaatcgaaaggaatagcccaagcgccaaatggtgaacaccaaaacgactcctgctacagcatatctcatccagacgagctcaagtggcgggacaaccgctactgttactttgacaaccacgtacatgccgccccaaatacttgctgcgattgctaggtaaagggcgcctatatatttttcattcatcattttccctccgttattggatattttgagtaccatatccacaaacggagatcactctccgttatggacggagggcatttggaacatcatgttcaaacaaaggtttccacagcatttgtcgtcactccaattatttttattttctgatactttataacaaattctggttgacttcaatcctttttgcaccttttttcttcatataatagaagataagcggctattgacatgctaaattcgttttcatatagtaagtaaaactataggtggccacgcagaaaaggagtagaggtcgttggatattgaagctagaaaacagattcccaccacggaacatgaaccatttctcgagggaataaaagattgtgtgccaaccctgcttggttatatgagtatagggtttgcctttggaattgttggaattagcgcacagttgagcttatgggacattgcgcttctatcaatccttatttacgcaggtgcttcacagtttattatctgcgcactgcttgttacggggagtcccctttccgctattattctcactacatttattgtgaatctgcgtcatttattgctaagcctgacgctggctcctcattttacacgctactctttaaaacaaaatattggattcggtctattgctgactgatgaatcctttggcgtagccatgaataaattagctcagcatggaaagctgaataaccggtggatgcacgggctgaacataacggcttatttatgctggattgctgcctgtgtacttggcggcatttttggacactggatttcaaatcctgaagcacttggtcttgattttgctctttccgctatgtttgctgcactgctggttctttctttgcaaactgtgcctaaaagtaagttaacccatcgcctgtcacttgttttgtatatggtcgttgcaatgtttctcctgcttcattttgttccctcacacgtggctgttctgttagccaccatgattgtcgcaaccattggggtggtgacagataaatgatcagcagttttatgatgtggctcattctcggctgtatgattgtcaccgttattccaagggtcgttccctttatatttgtacgaagtatcgagctgcctgaagtgatgcttaaatggttatcgtttattccgatttgtatctttacggctttgattgcagagcatttgttcattcatactacaacgggcgttaccattcactggatgtaccttgctgtcttggttccgaccgtcgtaatcgctgtttggacaaagagcttgtcacttactgttcttgtaggcgtcatgctgatggggactgccagatggtttttctaaaagaaaaagcttaaccgcatgtggttaagctttgtttcattctacgattccgtatacaaatccatcgtaacccttttcaccaacagtttgaatggctgtagcctctattcttgactcttgtttgagtaaattgaaaaattcacgagttccttgcactcgctcatccccatcagagtcatgaaggactgctccatttctgacgacattgtctgcaataatgactgttccctttttcgagaagtgtaacgcccactttagataattcgggttgttcggtttatctgcatcaatgaaaatcaaatcgaatggaagcacagccctctcttttaactgagatagcgtatccaatgcctttccttgcaaaatgctcactcgttccgataagcccgctctgctgatgttttgctgcgcaatctgtacatggtggctgacagcctctaatgtgatgagttctccatcctcttcaagagcacgcgccaaccaaatggtactgtatccaccgagtgtcccgatctctaaaatgcgctttgcattcttggtttttgctaataaatatagcattttcccttgagctggtgacacatcaatttctggcaggcctgcttgcttattatgagtaagagcttgctccaaaacatcatctttaggaatcaacttgtctgtgatatactcgtcaactttctcccacacttgcttcatctcatccatctcccttgatcatgtcttctgttttcagtctacatgatgatagcgagcgcgtataatcaattcttttcacacatctattcattttattgatgaaagacatgtcatgatggagacatgaagcagtatcatgttttcgaatttactcgttcaggtgatttttcaaatccccttttttatcttgaagctttcctttggcttgatccttcttcccttctgctttcaggttttgatgatctgttgcttcgccaagcttctctttcaattgacctttggcttgatttgtttttcctttcgctttatccatatgtcctttttcttcactcatttgttccacctccacgtttgatactattcatttagcctttttcacagatacaaaacatctgaatgtgcgatccaagaaactacagcaacataaaaatccagccaaggtcggctggattaaaaaataatgatctataagatagacttaaaagctttaacctgttttactctgatcgtactcgaccagatcacctagaatttcgtcaatttgatttatcatctcagtttcaattttcacctcagatgctaaagcattctccctcacctgttctggactagaagcaccgataattgctgcagaaacgttctgattttgcagtacccatgctatcgcaagctgagcgagagtaagatcaacctcttgtgcgacgggcttaagcttttggatcgcctctaaggtgttattattcatccagcgttgatcaaggtttttaaaaaaaggttttccagcagttgagttagcacgcgaattagtcggaagtgattttcctgggagatactttccagtgaggattccctgggccaaaggcgaccatactatctggccaagtccttcacgctggcaggtcggtattacatcactttcaatgattctccataacatggagtattgaggttggctggcgattagggggacatttagctctcgtgcaagcgctgcccctcgagtaatttgttctgctgtccactcacttacaccaatatagttcactttaccctgtcttactagatctgcgaaagctaacatcgtttcttccagaggtgtagttggatcaaacctgtgtgcatagtaaatatcaatataatccgtttgtaaacgccgcaaagaggcatgacagttttccaaaatatgcttgcgtgataatcctctatcgtttttcccagtaccggttggatgacatacttttgtacatagttcaatgctctcccgacgaatcccttttaaagacctgcctagtatctcttcagccttggtgtctgaataaacatcggcagtatcaaacgtcgtaatacccacatcaagagcagctttcacacaatcatgggcagtttcctcatttatcttaccaccatgattaatccaatttccgtatgcgagtttactaattgttaatccactatttccaagtttactatactccataacaatgtcctcctttgaaagaatactttcattataaaaaaagggtattaatatgtataatatatatattcagataattatatatatattttatataattaaaatatttccattaaaaaagcgcaaaactgtttgataacaatcctttgaaatcattttacacaataagcaagtatgaaataggggggcttaaaaatggatctgagacaaatacgttattttataatggttgctgaagaactaaattttagccgggcagctgaacgtcttaaaatggcacagcctccattaagtcaagaaatccgaaaattagaagaagagttaggtgttacgctttttcatagaacgagaagacaggttgaactttcagatgcggggagagtatttttagaagaagcccgccgtacgctccttcaagtagatagaacgattagcgcaacacaacttgcagatgacggaagaataggtcatttaacgatcggtttcgttgattctactgatattgtgattgatattattaaaaggtttcgagaaagtttccctaatatccatcttgtcttatgtgaaatggctacagaacagcagttaaaggcactatataagaaagaaattcaaattggatttattcgttctaaccaaaataataagatacttacctcagaaatttgttgtgaggaatcattaagcttggttttgccagaaaatcatcctttagcttcattttccaaagttccaattcatttattagccaatgaaccatttatcatgtttccacgtcatctaggtgcagcattttatgatttaattatcagctacttttgggaaaatagcataagtttaaacgtagttcaggaagctattcaaatgcatacgattgtgaatttagttgctgcaggaatgggaatctctgtcgtcccatcctcagtagaaagcgtaaaacgctcaggggttgtttatagaaaaatccaagaaactacgccaaaagtaaatttatatgtttcatggagacaagatgaaacgtcaaccgtcgctgagcactttttaacagttgtgagagaagcttatttaagttctcagtctaaatcatgagaatccagccaaagccagctggattaaaaaattatgatctataagacaggctttcctgatatgtacacgtttcaggtatgatagacataacgaaaagaaaggttggtgttctatgattatcgctgaaaacttattcaccgttcgtgacttgacctactgtattcggtctgctgcaatcggcgatgccaagcagttatcagcgctcagactgaaaattgatggtgaaacagaatatttagaccgtgaaccaggcgaagcctttcttcatgaaaaagattttgaggtgttgattcaagaggataccaaacaaagcaggcatttatttttggtcgctgatattgaaggagaaattgttggtttctccagatgtgaaggacattcactcaaacgctctgctcacaaagtgacttttggcgtcgccattcaaaaggatgcttggggctatcacattggcaaagagctattagccgcttctattgactgggctgatcagcaaggcatccagaagatgtcacttcaagtgctggaaacgaaccaaaaagccattcgcttatatgagcaccatggctttctgattgaagggatattaaaaaatgataaacgtctggcagatggactttattacaatactgttgtgatgggcaggcagcggccaagcttctgacaccttacatcacatagccccataccattgaaaccgcactgtatatcagaagcaaccccatgacatactggaacggtctttcgtaagcagtcaaaaagcgcttatacaaagagccaaataagctccagctgaatgtaccgagaaatccaataagtgcgagaatcagcgtccatatgacatactgcatatgagattgtccatatggcaaaacaaatgttgaaatcacagtcaatccatacaagatcgcttttggattgataaattgcagcatcataccagggacaaaatgattgtaacgatcaagtgtttcgtcatccccgcctttacttttcatgattttgaccgctaaataaatcatgtatgcagccccgatgaacgccatgacccagcctattttcggcatcacttgataaagtatgatattaaagaagcaactcaaacacaaaataacgagaaatccaatacccacacctaaacaaaatcgaaatgtttgcttgaccccatatttattcgtaaagaccatggccatgatgttatttggccctggggtaaagctgctcacaaaagcatagatcaacatagaaagaatcatagttgccgcctcccttatacgttattaagactttaattactttattgcgtatgttacgctttattgtaacgtttggtctttataaagtaaatagagaaaggagtttttttcatggaagatgtacaatcgattatttctaaaaatgtgaggcttcttagagaccaaaagaaattaagcctcgaaaagatggcagaattaactggtgtcagcaaaaccatgattggacaaattgaaagaggagaatcaacccccaccattacgactttgtggaaaatcgccaacggattaaaggtatcttttagtgagctcattcatgcaccacagcctgaaatcaaagtagtacgcaatgaggatgcacagattttaacggaagatgatgggcgatatcgcgtgtatacgacttttccttttgatgaccgagggaaatttgaagtgtaccgagtagaaattgatcctggcgggtcgctgcatgcaaatgaacacattggcgggacagaggaattgattaccgtttttgagggagcgcttgatatatccattggagatgaacagtacagcttaaaagctggcgactccattcgttttaaagcagaccgtacgcatacgtataaacaaaccggagagcaaatggtccggctgcaaatgattctttattatcctcaataaaaaagctgacaggcttgtccacctgtcagcttttcgtttatttaattaaatcccggatcacgtacaaccgttccagtatatgtgactctgtatttgcctaatcctaattcttcaatagacgattgttttaaaataccgacccagccatcctttgcatatgtaatacttgatgggatgttcgatgtcgtatacgttcttgtttctgagacagttcgacttgcctgaaccgttatttcactttttgtttgttcctttgcttccaccggagcagttgtgaccccagcacccgttaagacaattgctccaaccaaaacagaagacatgacctttttcataaaaaatccctccctttttttgttgaacatattaaccataccataatttagttcttttataagttattttttcacttttttgaaaattatgatatgattgtcttatgttggatagagagtgttctatacttctatgcttttatcctcatctcattccgtcaaacaattgtgaacggaggtgatttcatgaaaaaatggctcatctgttttcaacttgttttcctcttcaccttgacgaccacaccacttgcttctgctgcttcatgtcctacagtgaaaccttgtgtcattgatccttaagcatcaaaaaggtcgatcaagcctattcacttgatcgacctttttcgttatgcttgctctgcttcccagcgggcaacctcttctcttactttaggagcgacttcttttccaaataactcaatggcttttaatacttgatcatgcggcattgaaccaaccggtacatgaagcataaaacgcgtgattcctacattttttctaaggtgaatcactttctctgccactgcatctggatctcctacatacagcgcgccttctaacgttctcgctgcatcaaatgtagaacgagtatatggaccccagcctctctctcttgctaacgtgttcatcacatgctgtgtggaagggaagaattggtctgctgcaagatctgtttcttgtgcaacaaatccatgcgaatgggatgctacggttaatttctctgggtcgtgtccagcgtgtactgccgcttgcttgtacagctgaacaagtggtgcgaactgtctaggacttccgccaataatggcaagtactaaaggcaatcccaataatccagcacgtacgacagattcacggtttcccccactgccgatccaaattggaagcggatcttgaacaggtcttggatatacgccgacatcttgaatagccgggcgatgctttccgctccatgtgacacgctcggactgctgtaatttgagcagcaaatcaagcttttcttcaaataattcttcataatcattcagatcatagccaaacagtgggaatgattcaataaatgagccacgacctgccatgatctctgcacgtccgtttgatagtccatctaatgtggcaaaatcctgaaagacacgaacaggatctgctgaggaaagaactgtcactgcacttgtcaggcggatattctttgtctgtgttgccgcagccgctaagacgacagcgggattcgatgcagcgaaatcttgtcgatgatgctcacctacaccaaatacatcaagaccgacttgatctgctaaaataatttcttccactacttctcgaatacgctgtgcgtgactgactgtttttcctgtttgaaaatcaggtgttgtttctacaaatgtactaatccctagttccatgagtggaaccccctatcttataagtatgttacgaattcagagactggctttctgtagcccctcacttgtctgctctctactttttcttttccgagtgtgatcattaatacaggaaccaaatccgattcgatgtttaacacctttttcatgacatcagggtcaaaaccgatcattgggcacgtatcccagcccttgtttttggcggcaagcataaatagcatcgcagataatgaagcattgcggattgcctcttctttctgaaaatccgcccctctcttttcataaaagctcatcgtctctctgaccatttcttcgtattgctgcttgtttaaaatgccaagcattttcagaccttcatagatgttccccgcttgctgataagccttcgggtctcccagtacaataatcgctgctgaggcggaatgcactttatattgtccaaacgcggcttctcttacttgttctttaagaccttctgtttggacgacgacatattgtgtgtgctgtaagttaaaagcagatggtgccattttgacttcttcaaatatactgttaagttcttctctcgaaatcgagatattcggcaaaaaatttgatgcagatcgtctttcacgtaccaatgtatcaaagctgagtgtcatcttgtttccccttttcgtgaagttgttttgcacctaaaccgactttttttagtaattcaatgagctgttctttttcttctttttcaataaaggataggttttgtgaaatgacatctgtgtgcttaggaaaaatgtcgtcaaacaattgcttccctttttccgtcagcaatacatgaaatacacgtttatcagagggggcacattgccttttcacaagcccttgtttttctagtttgttcacgacataagtcatgcttccacttgggattgacaggatgtcgctgattttttggacgggatgcggccccttactatagagcaattcaaggatctgaaagttttcaaatccgatatcataacgttcaatgtctctttgaatatttgtaaaaagagcttgataggctttcatccatacgcggaatagccttaagtctaattcatgttcatgctgcaccatggcaactactcctttttcaagaaatcctaaaactaggataaatttatcctaacactaggatattttattgtcaacgagtttgtttcataaaaaaaagaccacctcatgtcagtgatcctcttcttttaagacaaaatgcatttcagctatctgcttatattgtcgtacttcttttaatgaaaacttggattccatatccgatggggaaaacagaggaatgcctctcccaatcatgacaggtacgatttgaaggtaaagctcatcaaccaatccttctcttatgaaagactgaagcagctccccgccgcctacaatccagatatgctgacctgtttcattttttaattttttcacaaatgataggatatcttcgcgaatgatgtgagttcctttcagactgtcttgtaaagtacgtgacatgatataacaagtctttccttcataaggaaactcatctggtgacagctgaagaacctgttcatatgtattgcgccccatgatcagcgtatcgactgacgcataaaagtcatcatagttcgtatcttcttcgccctccgtccctattaaccaatcgagccgatgatcctctctcgctaaatagccatcgatactcattgccccataaaaaagcagcttccttttctgactcaatctcatcactcctcacctgaataagtacatacgttctatattgattgtatcagaaaggaaagacaaatactatatggctttctcccttttatgattcatgctccactttgacgagaagctcatataatttgtgcgctagctttccggcatcaattaacatgtcttcatgaatccattcttcaagtacgccaacaacaccagacacgacaaaagaagcttcaatttgttctttctctgtaatgggccgctctacaagctgccactctttcatgattttttctttaaaaaacgctttgaattggttggtcgttggaccatttggttttacaaataacgtcaacatatattgattctctttcaagtactctgtcgttttgtttaaaaaggaaagcatatcaagagggtcttgactcggaaaggtttcatcatataacccgccaagctgatcgaatagttctttctccagctgttcgtataaatcaaacacatcttgatagtgcaagtaaaaggttccccggcctaaatctgctttccttgagagctctgataccgttatttgctgcacttctttttcttttaatagctcaagaaagctttcccgaatggctctttttgttttgattgttcgtctatcctgcatgagataccctccatttttgaacaatcaggcacacgctgtctatttatgaacaggtcatcattcattgccgatgttcgtattgtttacttcttattataatcaacacatgttcaataatctatatctgttcaaaaaaggaggaccagcacatggttcatttcagacttgctagagaggacgaactgccggaagtggcagatctgttagaagattcgtttcgggattattcattttttgatttattatgtgaaaaggtatcaaagcgctctgctttcgctcgcgagctgcatttggttaacacaaaggtttatttccagcatcaaatctgtttagtcggagtgaagaacggtcatattgtgtctgccgctctgttaaagcatccacgtcttcctgaaccaggtctcatggattatgtgttgtcaggcgggttaaagctcctcttcactggcggtataccggcaattcagcatgtgtttcgtatgttaaaggaggccaaaaaagcgtgttcttccttaaagaagcctttttggtatttagaagcacttgtcgtcgcaaaaaaccagcaaggaaaaaaacttggaagccgtatgttaaagcaatgtctttttccctttatcgcccgacaaggcggcggcctgttcacgctgattacacacaatgaagcgaaccgtcatttctaccgaaaaaatggatgggtggagtttgatgaaagggtattgcgcggaaaagaaatgtccatacaaagctggagttataaaaccgtgattcaataaggtatcctcttcagggaatgatataataaaatcagttcaatcaatgatcatacttggaggagagactgatgatacgacgacttgatcatatcgtgttgactgtacaacatatagaggacaccattcgcttttatacaaacgtattaggaatgaaggaagaaacctttggagaaggccgtaaagcgcttcgttttggtttacagatgatcaatcttcatgaagctggtcatgaagaggagcgggcagcggctcatccacttccaggctctagtgatttgtgctttatcaccgatttagatatggaccgtttgctgctgcatcttcgcaagctagtgattcctattgaagagggaccagtcaggcgcacaggcacattaggtccggttgaatctgtttttatccgtgatcctgatctgaatttaattgaaatatctcgatatatagaggagggtgatccctcatgacccgcttatttttgagaccgattgaagaacaggattatccggggattcaaagaggatgccagcatgcagaaacactttacatgactggcacacgaaaaatgttcacactagaagaaattcgttcagcctacacccgatttttacaagatgatagcaggcgagatttcgccatttgtctgttagacacgcaagaaatgattggggatgcggcgattgtggatattgatccaatcaatcatacggcaagcttccgcattgcgcttcatgggccagaacatttccaaaaaggctatggcactgaagctgtccgaatggttcaagcattcgcctttgatacgttagaactcaaccgtcttgagctcgaagtcttttcccacaatccgagagcctttagaagctatgagaaagcaggatttcaatatgaaggaaaaaggcgccaagcactctatttcaacggtacctactcagatgtcatcatcatgggcatccttcgtgaagaatacaatcagatgaacagtggagatgcccctgcttaagaaaggacatcttttttaaaaaattgaatcactgtggcgatgatcaaacaaatcatggaagagagaacgatagagacgctggatatactaagcgccatgccttcccatctgccaatgaagaaactggatattaataaaaccaatccaaatagaatgaagcatatagggaggatcagccccgcatgacggcttctacctcttttccctgcccaccatgagagacacaatacaacaattgtaaaaatagcggtttgcagccaaaacatattgtttcaactcactttctcttttttattttatgacgatggaggtacttccaatgaacattagacccattgagcaaaaagacaacccgtatatcgcagcaattatccgtcagtcactagaatcggcgaatctggcgatagaaggaacagcctacactgatcctcatcttgaccagctgttcgaatactatcaatcattgactcatgcagcctattggattgctgaagagaatggcgatattgtgggcggcgtaggcattgctccatttacaaatggcatatgtgaattacaaaagctttatttgagtccaaaggcacaaggaaaaggtgcgggcaaaaaactgatggatacagcgctgcaatatgcctctacatcctatgaagcatgttatttagaaacccgccgagaattaactgcggctacaggcctttatcagcgatatggcttttctcttctctcagagccgattgaaggctctgagcattctgcaatggatgcttggtatctcaaaacattcgcatcatgagctgtaaaacaatcgataggtttttgtccgctggaaacctagcttttctgctaatttgattgaagttaggtgttggacatcgcaatcccaatgcggtgtcctcttattttcaaggcaactcctgatcatatgctgacatgccagctgcgctcatgttctttccttccattatatataaagctcaggacatgcagtgactcattgcaacaaataaaattctttatcattcgctttcttctattgctatgctcattgtgaaaggaggtttatgaatgaggctttgttttatttagaatcaagaaaagattgtgacataagtaaacgtcatcaaccatccacatcgcacaggcattaaatcacctgaagccgcagtcttaaaaaaagagacctcgtttaaaaggtctcttacttcttcattcattattctgctgctatctcttctgtcgccttccccttccaaatcagaggtaagcctacctgcgaataaaaatgggacatgtatatttttatgccgccaagcgcccgtgtcaaagatcgtaccattacttatgtaggcagagttcatttccctacacatattgaaaccgcattggaagagataataaatcacttgacgctgaaacttaacagagcaatgtttcttgtcatcatctcatatgatcattcgctctctctaaaaatggatcatccctaattctactgctgctttaattgcttccgctcttgaagtgacctccagcttttgataaatatttgttaaatgagctttgacagttctctcggaaatccccatatcaaatgcaatttccttacttcgaaatcctctagccactgcttgcaagacaagcatctctttttcagtcagcatgtttaattcttttttcaaatggtttggagtcacttgatgctctgttgattcaaataccttagctgcgacgtttgcttgaagaagaatatctcctctgatagctgcttcaattgtataaaataaattttccctgctggcatcctttaaaagatagccctttgctccaagttgcagcccttcaatcattaatttctcttcgttataggtagtgagaatgaggaccggtacttttaactgaagagactgcatctcttttagcatctcaagcccactcatgttaggcatgttgaggtcaagtaatacaaggtctggagccttctctttcaagacatctaatccctttgccccatcctctgcttcaccaacaacatcaaatcgttgatctgtctcaagaattaattttaacccttctctaacaacaaaatgatcatcgacaatcacaatttgataagacattgtttttactcctttttcaaaggtatcgttaccgtcacttgtgtaccttcatttttttcactttttaagcgcagctgtgcatcaagcagtcgggcacgttctgacataccaattagaccgtaatgccccgaagtggattcttgttttttctcatcaaaacccactccattgtctgtgatttgcaaggagatgtgatcacctttttgctccatcatcaattcgaccttacttgctttggcatgcttggcaatattcgtcaaacattcactgacaatgtatacggtatgttcgatgagaaaaggggacacttgatatgagacagccatttttgtatgaactggaatattcgtcgccgtcataaagcgcttcacttcatctttcacagaatcagctaggtcatattgatcctggctatatgttcgaagatcgtcgatgaccaatctcgcctcagctaatgttgtccgcgcatggctcatagaacctttaataatgctttgagcacgctcaacattctgattctctaaatgtgcatggaccgcttctaactgcataataatacctgccagtccttgtgcaagggtatcatgtaaatctctcgccattctttgacgctcatttgtaagtgtcagctcttccacttgttgatgtgccaattcaagttcctttaaaaatgtttgtgtacggattctagctttgacttgtctaaaaaataaaatggagtatgcgatgactacaatcagaatcaaaaacaaaataggaatgtataccgtcaaatcatctgtatcattaaccaaaataagggcaagaaaaaaaagaacataaaaactaagccctgtcaaaatcaccttcaatgtatgataatataccccaatactttgcgcaattagtactggtaacagaccaattaagatcacaggggtagccgcctgcatgactgaaacacaaagtagaatcacaattccttgaatcagaaaatatacccatggattctgctgaaaccagtaaaatgaccaccaatggagaatcagatgtatggcaataagtgcagaaaaaaacaggctggaaattgctaatggggtggttataaactgaaatatcattgctgcaatataaacaagaacgacccataataatgttggaatccgtgaatagatcatttcattaaaagggtctacccgtcgtttcgccataaataatcaccatccgagcctcatattcactcaaaaaataccgcccaccctttatcgaggtaatggcggtatcatcaatcataccatgtaagattatcagtgactaaatcactttctcttctttctcttctttctgagaaatagactcaccttcaatgtctatacgtggaagccacctttcgaaccatttgggtaagtaccaagcagctcgtccgatcagcatcatacacgctgggataaaagtcattcttatgacaaatgcatcaaacagaacgccaaatgccaacgttaatcccattgttttaatgatcaagtcatctgcaaagataaaactagcaaagacgagaatcatgattaagcccgcggcagtcactactcttccactgtgcttcaaacctgatacaacggactttttcgcatcacctgatagaaggaaatcttctctcattcgactgactaaaaagacctcataatccattgcaagaccaaataatattcctgtcactagtacaggcataaagtttaacaatgggccatttgctggtattccaaacaatgacgcaaggtgtccatcctgtaaaacaaagactgaaaaacctagtgtagcggtcaatgtcataaggaatcctaaaaccgcttttaatggaacaaggaatgatctaaacacaagaatcatcaaaatcaaagcaaatccaataatgactcctgcaaatttcggtaacgcttcactgagtctatctgaaatatctatattaactgccgtagaaccagtaacaagtaatttcgtatcatactttgcagcagtctgactagattcatttcgtatatctttgactaattgctttgtcgccttatcttctggaccgcttttcggtaagatggtcagcatggcgtacttacccgatggattaggaacagccggtgccatttgtttgatgccatccatcttctctaatacttgtgttgttttctcaatagatttcgttgcgttatttgtatgggaggcatcaatgataacaaccagtggtccattaaaccctttgccaaacccttctgctaacaggtcatagcctttgcgttcagttgtttccttccctttcatgccgttatcaggaagacccaactccatatgaagtgctggccaactgagtagacccgtcaatataatgacacctaggatgatcttacctggatacttcttgataaaccttccccaagctgcttgttcttctttttgttgagattgtaatttagagaaccatttattctttcttgaagggcttactttatcaccaagaatccctagtatcgcaggaacaattgtcagagacacaagcataactgatagtaccatgaatgcagctacaagacccataacgcctaaaaatggtataccgactaatacaagtccgcatagtgcaatcacgacggtgacacctgcaaacaatacagcactgcctgctgtagcaacagctctagcagctgcttctttcaattcgtaaccctctgctaatagctgtcgatatcgagaaatgataaataatgcataatcaattcctacggcaagtccaatcatcacagctaatgtaagactaaatgcagacatatcaacaaaatttgaggtaattaatatgaccatcacgccgattattaacccaatgacagccgtcaagatcggtagtcctgcaatcaatagtgaagcgaaggtaaaggctaaaataaagaaggccatgacaatacctatgacttccgaaatcccgccaacctcaatttctgagaatgtgacggagccgcctaattctgtttggatgccagcctttcttgaaatcttaatactatctaatactttctcttttgaggatgtttttacctcatccgcctttacccggtatgtaatatccgcataccctattttcttatccttactaatagcaaatgtctgatataaatccgtcacttgcttgactgctttatcctttttgacttctttgatcgtttcgttcaatttgtttcttactttttttgtttctaatgtttcacccttaggtgctttaaaaatcagacgaatcgtcccgccatcatcacctgctgggaactttttctccaagagatccattgccttttctgactttgtacctggaatcgacatatctccattaaatgaaacacctgtccctattgttgtcgccacaacagctactaaaacaagtaaccaaccgataatcatccgtttcggcttagaaaaagcactttttcctaaatgatataaaaattttgccattcacttactcctttttcttcaacttcgtgaacttcatctttttattctaagcaatgagatgatcgattgaaattgtactttcgggcaagaagcattgtacttttaggcaacaaaaaaagggcatcttcttaagatcccctttaaatcgtttatgaggcgactgttttttgcctcgttctgttgattttaccgacaaacatatagccatatttataatgatttgctaaccgtgacaataggataggtccagcaattgcaagtgctgatattatgaatatccccacaaagaatggataatcatttaattggccccatagcaacacagagatacctagaaaatacccgtgaagcaaatagatggtgaatgaatattgactaatgacagctacaaaaggtggaacgcttttcactttagaaaacaagagaaaacataagaagacaatactgactgtataaagaacaacgtctggcctcttagaagaaggctcgaaaaaacctacatatgaattgcttagaagggtcgcggctgaaatcaaaacaagtccatacacggcatacttaaaacgatgaagtcttgtgataaactgctgataattcgctccacaataataggctaaacaaaaatagaataaccaacctggaaatggaatccattctaagccgaacattggattaggtaattgaggttgtgggattttgacgaggttcatgacacttaaataaccaactgtgatgataaaggagatcggcaatacccatttggctgaggtacgcttagccattttgtgaaaaaacatgtgcaaaaagtaaaattgaaaaataatcagaacaaaatatccaatataatttcccaataagacatttgctgaagctcttttaaagaaatcagctgctcctccatttaacgatgccgaatgcaaaaacccatcgacaatcccaataaatgcaaatgggaaaaagatggctttcactctcttccacataaatcctttgggtgtaccatttggataagaatgcgccaataaaaactcagaaatgaaaataaaactcggtgtactgaacatgagtagtgctacaagaatagatgatgaatgggggctagataaaatggctattgcatgaatgagcacaacactcaaacacgagatacatcgaatataaaaaatctctttaatttgcattgaaaatcctcctctagtattttggtaaaatattcatcatattaacatgaataacacctcatcaacagagaccttgtgattatttcaatactttatccacaggaacaaaaaaaagagcccttgttagagcccttaatcagatgcaaccgtcgccttccccttccaaataaaggttaatcctaatcctagaaataagacaacacctgcgaatagaaatgggaaatgtatatttagatcgaataaaatcccgccaagggctgggccaaatatcgtacctagacttgtgtaggtggaattcatccctgcgacaaatccttgctgattgccagcgatttttgataagaaggtcgttaatgctggacgcaataaatcaaatgctaagaaaattacacatgtgacaatgagcaccaccataaaacctgacacgacagttgagacaaaagcgagcaccgctccaacaatcaagcagagctgaatgactcttttttccccaagggtattaacgagtttcccaaacaccagcacttggatgataaccgccacaatcgagctgaccgtaataatcaccgcaatatcttttggaccaaatccaaacttatgatttgtaaacaggctgaagaccgtttcatacgcagacagtccaaacgcgaggacaaacacaatgataaaagcgatgagatagcttggatggatcgattttttcaaatctttaaagaaggtcgattccttcacttgatccatctgcttcgctcgctcttcttttgttaatggctccttcagcaaaaacatagacgaaatgacggctataaaggcaatccctgctgcaaagaagaatggcaggcgtacaccgtattctgcaataaatccgccaatcccaggaccgataataaagccggtactaatggccgctgatacatatcccattgcctttgatctttcttgaacggtcgtgatatctgcgacataagcagtgacagcaggcataataaatgccgcactaatacctcctagcagccttgcaaaatacagcacatacacgtgtgtcccaagaccgaagacgagttctgataatgcaaatagaaaaaggcctgacacaatcataatctttcttccgtagcggtctacccatctccctgcaataggtgatgtaatgagctgagccacagcaaacgccgccacaaggtatcccatcgtactccccgtcagatgcatcacattcatgaatagcggcatgacaggaatgatgagaccgatgcctaaaaaggcaataaatatgttacttaataaaataacgagtacagctttttgctcacgaatcggtttttgcatgatgtttgtttcccctttattgattcaattgttactcatgatgattgattccgtgaataatcaatgagatcgcttgtttttgtaattcttttttctcttcgattggatcatttttatacaacacgtctaatccgtaaaaaacggataataatattttcactgttgactcgacatgctggatcgaccagctgccatcttcgttaccttcaagtatgatgtctctcatcacatcatcaaagtctgcatcaatcttgttcagccgttccatgacctcggcggatgtaaaggcacttgcacaaaattcctcacttgctctcattaatgggtaattaatgcccatttgactgagcagttctgcaaatcctgcgagctgatcaatggcctggtgcatcgtttgtttttcctgatgccacgtctccatcatcaagaggtgatcctcttccatgatatgaaggaacaaaaactcttttcctttaaaatggtgatagagattacctttactcacctcagccgcctctagaatatctcgcacagaagtttctgagtaccccttttttgcaaataaatcacgtgaagcggtgacgatttttcgcttcgtcttctcgctcttttcagccccgctttgtgtacttgtcatcttttacaatcccttctaccttgcttttcttcattaaaacaaatcaaaaccgaccagttggtttattttttttattataaatggatttttttcgaaatacaataaaaaagtcatcgaaacgatcacttgtaccacccctcatttaacatttcttaatatttaacttcacttaactataaacattgcctataatgaaatagaggtgatgtcattggatgaggaaatcattcattacagtaaaaaaatcattgaatactcgaatgcactaggctccatctatgtagaagagtatcaacgatttttaaaacatgaatatgcagatttatcagccaaacaagagctgacacttgaattattacggacaaaaacaagaaccatcaacgaactagctgattacttttccatttcggcaagtgccgctagccagcttgtatcaaagctagaacagcttggctatgtcaaacgagaaataaatccacataaccggcgggaaatcattgttgattttgctcaaaagggtcatgactttcacaagaatacagaagaaattcaattgcacctcattcaaaaatactatgcaaagcttcaaaaagaagatttaaaaacattattgtctctatacgaaaaaatctatcagattgcgaaagaagcgccttgatctggtgtttctttctccaacatttaagttaattaaactattaaggagatgaaaatatggatagcattcatttacaagatggacgtcatattggtttgtgtgaatacggggatcttgaaggatttccagtattcttttttcacggaacccctggatcaagagtgatgtttttagatgatgacccgatttctaaagagctcggtgttcgtctcatctgtttagacagaccaggatttggtttatctacccctcaacctgaacgcgcgattttagattgggcaaaagatgtgctaaaggtagcagatcatctcggtattcaccatttttcagtgatgggtgtatctggaggcggcgcattcgctgctggctgtgcttatcaattgccgaatcgagttctttcagccgctctgatttcaagtacaacgccatttcaggacggaaaaccgcctaaaagtatgctcaaagaaaacaaattggcttttttcctcagtaagaagttcccttggttattgaaagcaagctaccgttctcagaaaaaaatgattgagaacaaaccggaaaaatttaagaagctggccaaaaatgggaacaaacatttacatccatgggaccgtcaatttcttcaaaccgatgagcaattagagatgatgatgacacatttacacgaagccactcgtcaatcggtggatgaatgtattcgtgaaccagatttgctctcgcgtccgtgggcatttgatatgaaggatatacaaatccctgttgatgtatggcatggaaaagaagattcgatggctccgtttgccgaaatagaaaaaatggcgcctagcattccaaacgtcaaaacctattatatcgatgaagcgggacattttcttacggatgtagacgatatttggcgagatattttactctctttaaaaacacgtgcaaaagggcatcatcaggagcacgcataaaaaagacccgaagcttcgggtccctttcttcattaatacttttcataatatgtctgcactttacttggatcttttgtcttcgttagagcgagcataagcagaatgcgagctttttgtggattcaatgaatctgatgagacaaagtgatgttcatcatccattttttcatgggtcacaatcccattccccgcacggctcgatctcacgaggaccacgtctttcttcacggcatctgttgcccctttgatggcttcagttgacatcgttccattgccggctgcggcaacgactatccctttcgctcctgcttttactgctgcatcatacatgtatttttgatcattttgatagccatataaaatatcgacttgtggtaattccttaatgtttgatacatcaaattcactttctgacgtatgttttctgatcggttcgttataaaaagaaaccacttcaccagtaacttctccaatgtaaccatgttcaagagatttgaaggaatcggttgtcgtcgtgtttgtttttgtaataaatcgagctgatgcaattcggtcatttaatgtgaccatgacacctttgcctttggcttcttttgtggatgcaattttcacagcatgatacaagtttagcgggccatccgcactgatagcagatgctggacgcattgagccaacgactacaactggtttatcacttttgacaaccaaatgtaaaaagtaagcggtctcttcaagagtatctgttccatgtgtgatgacaatcccatcgacttgatcatcgtttaagagtttattcactcgtttggctaattttaaaagaagagcatcatccacattttcactgcctacattcgccacctgctcacctgttacgtttgcaatatccttaagctgaggaactgaggcaatgactttatcgataccaagtgcaccagatttatatcctgtcgtatctgtatcactgtctgagcttccggcaatcgtcccgcctgtcgctaaaaccttaatattagataaggacttattccctgtttctacggctgtcgttttgtccttggattccttagatgcggtttcgtttccgctatgatttttctcttgggtacttgtattggcacaagctgctgtcaacagtaataaaacagaaagaaggacagcacctaaccattttgttacgttcattcgatcatctcttttcttaaatgtgatggatacaaagctaggtctcttactataggatttactttataccattccttcattcatcagcatgaggcgaaagatacagaaccaaataaaggaaaaaaagacatgttcttaattatttatttacatctaaatacctaaattcacttttaaaaaagagaatattgaggttattcaatgaatgacagaaaacgatgctaaatcatcaatttatgataaattatagtaaattttacaaaaaaggagtctatctattacaaatgcttcaatcatttcacaaaatcctaatcacactattccttagttcgattttactcagtctgttcgtatgcttctatccaccgattcagggagtgcctgcgttcatggtattttacgttcccatcttttttgtttgttatttcgtctttgcggttcctttgcagttgttgttttctttgcagttgttgttttctttgcagccaaaggctttccatccactttatcttgctgcttatttactgatcgcaatggttgtcatgctttttgtgatcgatggtattgggagttcagtatctatacctattatcattatgagcagtttgatctactgggtctctgattctttgctttatcaaagaacatatgaaaaaaacggatgaggtcttcttctacatatgctgacacactaatcaatcatgccataaaaaaatcaccgagggcatcttccctcagtgatgtgtcttttctatttcatacttgaacccgcatgtgaaaaaatcggatctttcaattcaaaatcaaaggtcttaccgtcaacaataccgactgttttttcatggtcatacagctcaagcagacaagctgccatttcttttgatgtatgatatttcttgatattgccttcatattcgaattgatctacatctaatgaacgctttgcaaattctgattctgttgcggaaggtgctaatattttcgcctgtaacttagctccctttcctttcaactctagtgccaatccttctgtaaaggcgctcacgtaaaatttcgtggccgaataggtgacggcattgccgacgactgtatagcccgctcttgaagaaatgttgatcagctgagccccttctacttgctcataatcacgaacaaataaagtggataaaatcgttaaggcttcgatatttaggtgaagcatgtccccaattttacttaaatcttgctctccaatcgagccgaaatggccgaaccctgcattattaatgaaggtgtcgagctcatactcagccaatgattcataaaatgtatacacttgctccatgtcggttaaatccacagactgtatgtttactttaatatcgggatattgatcaagaatttctttcttcagttcttggagtttctcgagccggcgggcagctaatataaggtttttgcctcgtgctgcaaaggctagtgccgcctcatatccaatacctgaacttgctcctgtaatgactgtatagcccatttgatatccccctattcactattttgctcgactgtggaacgatgacaatattttatttttcttctgcatcgacaacagctacaccaatttttttattggtaggatcatatattccagaaaattttttatttctatcattatttaaataccctgttacttctattccgccagttggatcaatattatattcatttgagaaatcaatttgttcaatagattgatatccctcttttatatactgttccatatggttctttgcttcaattactaaggtttgttctttatcttttacacgctcattcttatcggattctaacttcataataaatcctccaactgctataataaacaccaatagtataaatatggtttttttcactgaatatcaccctttaatataattctacataaaatgaaaggatttgtatatattttgaaagagactcaaaagcgctcaagtctatcagatgaagagtactttagattaagcggtctagcttataatgataaaacaatttcattacataaagaaataaataagcctttaaaggttaatgaacattcttattggtttatagataaaattgcaaaagatcaagatacaggacttgatgctatagttttagttcaagcaaaaaaaaagaatggtaaatggattaaaacaaatacacctaacaacgttgtcgtagctttcgctggcactgatccaaaaaatcaacttgttcaagatgttataaaagctgatggaggaaacgtagttgcagggctacaaactaaaactacaacaccctatatcgttaaaaacgagactaaagattatactaaaaccatttcgaaatatactggttctccagggcaagaagctatgcttaatagcggtgaatacaaactcatcactaaaacctctcaattcgatcaatctgatcagctcgttaaagaagtaaaaagacagtacgctggtggcaatacagttatatcagctactggtcattcactaggtggagcagaggctgattatgcaggagtgattaacggtgtctattcagttggattcaataatccatctattgtaaagcttcatgacaaagaaactcaacagagaataaaaaatggtgatttcagagcaatgaataagtctatcattaacccagatgacatggttggtactggatggggacttgaatatgagcgacacaatggaacaacgatttatacaaaagatccatctgatgcaagactaaagagacacaaacgtttaaaagctactgctttgtctggtacgcttataccgattgcagccgactttatcatgcaagcacttggaattgatgacacccatgctataagcgagtctaatttcaaatttgatcagaatggtaatatcatcaatatcaatggaagtaaggatgtatataatcgtgacttagaaacaatgacctcttatgctgatatggatggtcaaacaataaaagtaaatcaggctgttgcaaaaagattagctgaacaactgactttagcattagaagagttgaagaacgttaaaaaagaagtagaagcatttccaaaagaacacagtttaacaacttacaatctttcaaatcaatttaagagtaaactagatcaatttgaacaacttgggccaaatgacgtcgatcaagccctattagaaatagctccgtatattgataaaggaacaccacttttttatgataaagaggagcaatacaaatttgaagcttcattgcattatatgattcaggatctagaagagataaccgaattcattgtaaaaatggcagaaaatctcacacaaaaagataaagaattagctagatggctgaggttataggaggtcataattagtgcctgatatgaacgctgaattagaaatgataaaaaaagtgcaacaacaaaatgaactaaaaagacagttaaaagcacaagcaaaaactgatataaactcattaaaatcagatattacaaaagcgacaaaactagcagcatcaacaaaaactattgctcagacatatttaacacttttttcatcatttgaaggtaaatcgcttgatgcattagtggatagactaaatcaaaatgcacaaaaaacattacaggttaagcatgatagaaaagcttttaccaatagcattagaacgaaataaagaaaataatcaaatcacaacagaagtaaaaagcacaggttacccctgtgcttttcctattttgaagagaaaccattatgacattttttcaaacgccttcttcaattgatcactcatcagatgccaagcttcttcagctatttctaaatctccggcatgcgtgaaggcgtgagggactcctttaaactgtctgtacgtgacatctacccctgcttcttttaacttctccgcatattgttcggcttcttgagctagcgaatctctttcagctgtgatcacgagagctggtggcatttgagccaaggatgagcgatcggcaaagattggagaaacgagcggattgtgcggatcttggccttgcagatagaaggcattaaagagcctcgccatttcaacagggatcgcttcttcaaatgctggcttttgtgctggatcagtggctaaatcaagcggcggatagtcaagcacttgatagacaatcgggagttggttccctttttggatatttaagagacaagcagctgttgccaaatttcctcctgcgctatgtccgccaatagctattgctttagggtctatttgaagctcatcagggtgttcatacagccacttcaggacatcgtagcattcatgaagagcggctgggaatggatgctctggggcaagctgatactcgacattgacgacgatacattgcgccctgtctgcaataactggacaccagtggttatccatttcagcactgcctaggataaatcctccgccatgtaaatttacaaaaacgggtagcgtctgctttgatgtgttgaccggcttaaatacccatacctttgtttcgccagcacttgttggaatgtcatattccattttgttcacttcaggaggatgaactggttttagttccgattgactcggtaatgaaccttcagttggttgacgtaaagacgcagcgattttgatttgctcttgtaagttcatgatctcagtctcctatcgtaatcatttcttcttaactcattcgtttctttttcctcttttccttctactgaatcagcggcacattctctttggttcactttttatctatctccccattttcgccctatttgaaacaagcattggacaaataaaaaaagcactgcggcgctaagtcctcagtgcttttcatctattttatgaaacttgctgttctaccttcactcgtttaatgaagaaagcgataattagaccaatgacggtcatgatcacagcaaagataaatgcatgctggacgccatttgtaaaggcgagcagctgattcatcggatttgagggatcagccacattttccataaagctgcgggttcctgatgacaggatggaaataccgaccgcagtaccaatggctcctgacacctgctgcaatgtattcataatcgctgtaccatgcggatatagctctggcggcagctgatttaatccatttgtttgtgcaggcatcatgatcatcgcgattccgaccattaatgtaatatgaagagtcacaatgtacccaatcgatgtatttacacttagattggtaaaacctaacatcgtcgctgcgacgatcgcaagccctggaatcacaagccatttcggtccgaacttatcaaataaaccacccatgattggagatagcagaccgttgataattccacctggcaatagcattaaacctgctgtaaatgtcgtaagtgccaaggatgtttgcaaatacaatggcaaaatcatcatagcagacagcatcaccatcatacacactaagatcagcagtaacccaatgacaaacatcggatatttaaatgggcttaagttcagcatcggttccttcatattcaactgtctgagagagaatacaagaatcccaatgacacctactacaattgccacgatcacatgcatactgctccagccgccgccttcaccggcactactaaagccatacacaattcctccgaaaccaatggttgaaagcacaatcgataagatgtcgattttcggtcttgttggctcagtaatattttgcatgaagataaaaccaaagacgagtgcagctattaatagcggaagtgaaatccagaaaatccaatgccaagtcagcgatttcaaaataagaccagagactgttggaccaacagctggtgcaaacatgatcacaagaccaataatccccatcgatctgcctcgtttatgaggcgggatgatcaccaatatcgtattgaacatcaatggaagaagcaatgctgtaccgactgcctgtacgacacgtgccaccattaaaatactaaagactggcgcaactgctgcgataaaagttccaatgatcgaaaagacgagcgacgtcatgaaaagctgtcttgttgtaaaccattgaagaatgagtcctgaaattggtacgagaataccaagtgttaataaatatcctgttgtcagccactgagctgtcgtcgcttcaattccaaagtctaacgttaagcttctcagcgccatatttagtgccgtttcactaaacaggccaataaaaccggctgtgataaatgagataatgatgggcagcgttcgaatttgagaagctgctgcttgctgtttgttcatagtaggttggctccttttctttttttcaatttaaatcaagcataggaagtgaggacggtcagaaatgagccacttcaatgtctattgaaaacagacaaaatctgtttttctgcagcgaattgagcgattttttcgattgaataaccagattcatgaatataaaacatcagttcaggtgtcatcggagaggacatacaaagtgtcgtcagctcaatatcctgtatgttcgcttcccctttttcatctgcttcttccagcaaatcacgaatcatttgccttagcgattgactgtaatgacagtcatacactttgcttgtctgctctaaattcccagatatcgtaagcatccgaatccagtctaaatgatgaccgacgatgagatgaatttcttcgagcacataacgcaaacgttcacgaaccggctggtcactgattttgctcaagtaaagatgcaaagcagggatcagctgttcaaatctttctccaaggatcgaaaggcacaaatcacttttattggcataacggcggtaaagagtaccctgcccaacaccagctgttttagcaattttatgcatgctgacattttccacaccaaattcctgaaacagagtaaaagcgacctcttcaatttccttcccaatatccttttccatgatgcttcaccttctttaccttcatccatattgcacttctctctatgtgttcaatcaaaactttttggttttcattaggacaattgtaccggtattatcttacggacaactgtccgctttgtcaatcattctttagtaaatagcctgaaaaagatcattttctttcgtaatttcctatgaaaaaaatagaagagtctagtaaaatatcctctttaatatcatatattagaccgattttccatttcgagagaatcatgtatgatcaattaagaaaacgctttcaaaacaagagaggggaatgcctacatgtcttaccgtgtgaaacgaatgttgatgctgcttgtcactggaatcgtcttgagtttgtccacatttactgcgggtgcctcggcccaaacaggcggatcgttttatgagccgtttaacaactataatacgggattatggcaaaaagcagatgggtactcgaatggaaacatgtttaactgtacgtggcgtgcaaacaatgtctccatgacgtcgttaggggaaatgcggttatcgctcacaagtccttcctataataagtttgactgcggagaaaatcgttccactcaaacatatggctacgggctttatgaagtcagcatgaaaccagccaaaaatgttgggatcgtgtcttcgttctttacttatacaggaccgactgatggtacgccttgggatgaaattgacatcgaatttctaggaaaagatacgacaaaggttcagtttaactactataccaatggtgtaggaaatcatgaaaagatcgtcaaccttggttttgatgcagcaaactcttatcacacgtatgcatttgactggcagccaaactcgattaaatggtatgtagacggacaattaaaacatactgccactactcaaatccctcaaaccccaggaaagattatgatgaacctgtggaatggtgcaggtgtcgatgaatggctcggctcctataacggtgttacaccactacacgcgcattatgactgggtgcgttacacaaaaagataaccacattacaaaaacctgtgacttgtcacaggtttttcttcattcacatggaattggtttttagttgatgaacgagcttttgttcataactgtggataatatcttcataactttctatcttgtaatctaaccgcttaatcgtctcttcgatttccttttgcttttctacaagtctttctctctcattgaccaaaatacttttccgcgaggacagggtatgatcctcgccctcgataaataaagccgtatattctcgaagtgcatcaattgaaagacccgcatttctcatacatttgataaattcaatccactgaatatcttcttctgcataatcacgaacaccgttttcatcacgacggatcggtcgaattaatccaatattctcgtagtatctgagcgtagcagtagataaatcgagctgcttggcggcttgtgctattttcattgttttcacccttctcttcttctctcaccttatgaaaaatgaaattccttctttttatcatctccaatttgatagagaacgcaagatgttctttatttaaggatgttgaaaagcctgaagagggttctctattgacttagagttcactttaagacgtacagtatagaagtagaacagaatcttacttttgaaaggatgatccagaatgtgtcagacgcaccaatcaaacgttttaagtgtttcacatgcaaaagcgaattttgaacggacaaccattgaacgaagagcgcttcgtccacatgatattttaattgatattcaatttagcgggatctgtcattcagatatccacagcgcctttgatgaatggggcggcggtattttcccaatggttccgggtcatgagattactggagttgttgcggctgtcggtgatgctgtgacgaaatttcagattggagaccgtgtaggcgttggctgctttgtggattcctgcggcatctgtgaatattgccaaaacggagacgagcaatattgcacgaaaggagtcgtccaaacctataataacctcgattatgacggggaaccgacttatggcggctatagtcagaagattgtcgtgacagaacgctttgtcgtcagcattccagatcaattatcccttgatgccgcaagtcctcttctctgcgctggcatcacaacttattctccgttaaagcactggaaggcaggcccgggtaaaaaagtggccatcgtcgggatgggtgggctcggtcatgtggccattcaattcgcacgtgcacttggcgctgaagtcacagtattgagccgctctatgaataaaaaagaagaagcactgtcatttggtgcaaaagactattttgctacaagtgatcccgatacctttaaaacattagccggccaatatgacctcattctcaatacggtctctgctaatatcaatgtagacgcctatttgtccttacttcgcgtggacggaaccttggtgaatgtcggtgcaccacctgagccagatcagttccatgtcttttcattaatcaccgggcgccgcagcattgctggttcactcgttggcggcatccaagaaacacaagaaatgctcgatttcgcagctgctcacaatatcgcaccacaaattgaagtgattaacgcaagtcaagtggatgaagcgtatgaacgtgtgctgaaaagtgatgtgcgttatcggtttgtgattgatatttcgacattatgatcgaattctatttggaaagaccagcgcaatggctggtcttttttaatggtggatattctgtttttcttgtattgaggattcttgaggatatgttgaaaaatcatccgaattttttatgaaaaaatctctcttttttagaactaaatttattgacaaaaaataaataaacatgttattattaaaaatttgattattttacgtcgaagtgtggtacccttaaagtagatacatgatatggaggcggatgatatgtttcaaattggtgataacattgtttatccaatgcacggagcaggtataattgaagccatagaagaaaaagaattttctgatgaaaaacaacagtattatgtgattaaaatgtcaatcagtcatatgaaagtgatgattccaacacgaaaaatgtctggttcacgtattagacctgttacagatatactggcattaaacaatgtgatgcacattttccagcatggcaaatcagatcaaatactgacatggaaagaacgtcatacaattaatacaaacaaaataaaaacaggtaacatccaagacggtgctgaagttgtacgtgacctaatgcggatgaagaaagagaaagcactaaatgcaagtgaaaagaaaatgctagatgatgcccatgaatttttgctaagtgaattagaagtcatcaaagggattacagaaaagcaaatcaaaagtttctgttaagaactctgccgtcttttgggcatccctcaccatttttgaattcatgttctctacgaaacgacccacccttcaattaatgaaagaaaaaagaatttatttagataaattccgcatattgtaaatccaatatgctatactgttgataaacctttgaagcatgaatttttttacgattaccttgtaacatctccctacttgtacgctgagtagggttttttattgaagaaataaatgaaagcacaaaaaaacaggctctctacagagaacctgttttaaaaaaatgaagattaagcagttttttgaacgttagcagcttgagctccacgagaaccttgctctacgtcaaaagttactttttgaccttcgtctaaagatttgaatccgtcaccttggatagctgagaaatgtacgaatacatcgtctccttcttcacgttcgataaatccaaaacctttttctgcgttaaaccattttactgtaccttgttccatgtttgttgcctcctagtgcgttatcacacaatgtattatactatccttgcccaaagtatcctcaagacgaaaagtctttcttcatgctatcctttacgccgaacaaaaataattattcttattgtaacacgattcggaaataattgcaatttaggatttaaaagagcactaaacgtgatatagtgacacaaataaaacagggatttaatgatgaaacgttcatttagctatgttcaatcctttgtgcataaaatcagtttttttcagcgcgaaaagaaatctttatctaaattctctctaaaatcgactgaacaaagttagtttttccctcggcatatttgtgtttgtcttttttatttaaacttgataggttcagtttgagctgctcgtactcatttctcactaattcgttacttcttaaataatccctgaaatttaactgttcaagtaaatatctattgcctgtttgatacatatggatttggtgtgtacgtggttctcctttcttgaaatagtgtctttcaggtaatacattggttcctctatatgaataaccaagcccttgcaaagctgttacgcactgtgtcccgtcaagaaaatgatctatttcaatcgcaatatcaataatgggttttgcactcaaaccatttattgctgtacttccaatatgatgcacattcaccgtgcactgaccaatgacctctactattcgtttcttttctctttcaaaatctttaccccattcagcagaccaaggaactaaaaaaacttcccctcttggtaatcctagcataggctcaaccccaccttatcatttcgttgtttagttggaaatctcaatagtttgaagcctttcgatcgattagaacgacatttattataagataactcaaacaaagagcccactcacataagatgagtggactttttttagaaactataaaaatcattaatacagccacgaacccgaatcaagaaaacttctatttatacaaaggtgtacaactacatattttccgactcaagtctgtttaaccagttatggactaatgagttaaatacatcaggttgttcaatttgcaggttgtggccagccatatcaagcactgcaaaagttgcccttggatagtcttcaatcagccgccacgcatcttgatatccgactacatcgtcttgacgccctgtgataatgagcgtgggatactgaaattcagctgaaatgtcgaaggtatagccatacccattttgaagaatgttattgatgaattcatgatttgtttgtttagaaggaaggtaaatttcatctcgaaatctttcccattccgtttttccttgcacaactgccatggagcaaaattcatccgtctcctctggagaaagttgtgatatcaagctgctgtcactttttagaacggccttctctggcaagactcttttatcgaatacaggtatagtcattggggccacaagcagtaatccacgaacggtttcccggcgtgaatgaataatacctctagctatgtaccctccatacgaataaccacaaacaataaactgttcatcaggaataatctcgtccaaaagacgcaataccgcttctaacatatcatctgagttctgaatagatggatgcggttcggaacgtcccatccccggtaagtctatgtatattcttttccaaccgctttgtttttcaaataccggttccaatgcatgtaacatcacttgatggtcaagtgtccaaccatgcaatataacaatcggaaatccttctccaatgactttatgataaattgacatgtatttgcatccccttttctagcgcttccctagtaatctcaagattttttgttgtttttcttcatcatagcttaaagtgaataaaatctttgttaggaagctatgctatgattccccaacgaacttctcacgtaaatggattttattatgactttgatttttctaattggttttcgccccataaaagaagttgttcaaatatagggatcagctctagtcctgccccagtcaatgaatattctactcttgatggaacttcattatactgaactcgttgaacaattccgttttcaatcaggtcctttaatgattgattgagcattgttcctgtaattccatacactttacgctttaactcattatatcgaatctcattgtaactacatagtacagctaagatttttaaattccattttcccgctaatatatttaatgcataactcgctggagctatcgctttattcagctcactttcagtcatattttatccaccccttagtcagtttttccttccttaagcagtttatattgcgtacttgttaaatcaattccatttattataatcaaatatgtaaaccgtgtcatccatgtattagagagccaaattgattataaaacccttcaagttaatactttttcaaggagatggagtgagtaaatgaaaaatgaaaagatgcgtgctgcacaatacactaattatggatcaccgaatgttctttttgaagattttatatcaagaccagttatagaatctggagaagtactcattcgtgtacatgggtcgagtgtaaactctatggatacactgtttcgatcaggtaagttaaaactattaacgggtaatcaattccctaaagggacaggagcagatttttctggagaggttgttgaagtagggtcgaacgtaaaaagttatcaattaggtgataatgtgtggggggttctccctattaatttaaggatccaaattggtagtgctgctgaatatgtagctatatcacctgagaaaatatctaaaactcctataaagattgatctcatacaagccgcggcattacctggcgtaggtgctactgcaattattgccttaaaatataaagctaaacttagaaaaggcgaaaagttactcgtacgtggtgcaagtggtggagtcggaagcattgcgattcaaattggaaaaatgttaggtgctcatgtaactgctcttgcaaacgaaaaacatcttacttttcttcaagagctaggtgcagacgaagtatttgattataaaaaaacatctccttctgatcttaaaaagtttgatgtagtcatggacacagtgggaactgaccttaaacattataggcgcttgcttgcaaagaacggtagaatggttactattggatttcctagtttttcgtccttcatatatatattaacttcaactattttcggttctcgtagagttcgcacattcagcgcaaatcccaaaaatgaaattctaaaagaattagcatcttatgtagattccaacaaggtcagaccagttgttgatagcatctatcgtttatctgatgttgccaaagcccatcattccttagaaactggaggtggacggggaaaacgtatcataaatttacttgataaaaaataaaccatcaattgacatgaaattatttaatttttctgttgcaaatggtgcatgcttggtagccatttcaaatcttccagctcttctaaagtattcagctgtttctaatgcaaagtcttcaatatcactatacattttcctactttttagaacccaaaacatcggtctaacaaatgcttatcttcttttaaatacagaccttgaagaatcttaaatttcgaaatataatcgacatccatacaattcaaatattttacatgttatgatgaatttgtaacaaaactaaacttagggggaagtattatgaataaactttacaaaggattaattgtttcagtattatcaatttcttcattagctcttccagctttaacaaatcaagcttctgcgcaagaacctgcaaaaattcacaatatagcaaagcctacaaatgaaattggaacggtcgatttccatatgttaagaaactcaaacgttggattgctgtatggctatacaagatgggaaatcatctctggcagtcaccttatcagtattagttctagtggtgtcgtatcttcttactcatcacttggcacggcgctggtttatgcctatgatataaacgataactacgtcatttttaagattacagttgaacctcgataattttgtttagaaggagtggtctattcactccttctaaaattttctttaattacatcgatttttagaaacaaaaaagaacagtcttttgactatcctttaaaaactcatacccccaattcttcagaggactccgataggcagctcaatagaaatgcactcccctataaaataatgtataattcttcttaatcacaacaatggcataatatggttaaaggagtggttatatgtcttatttctctttagttttcaagcagaattctccttcattttttgaatcaaatgatgattatttagccaaaaaagagacaaaaacaacacctatagagatttaccaaacaaataaagaggttaaatctttagctcaactaattgtattaaaaaataatgtatcagacaataaactgaacccagtttttgaaatcagcaaaaatatgaaagtaactttaaacgaactattttattctctcgattcacctaacgaagttaagtatgaactacgtgtctattatggccaagcccaatttataagtgcaaacggacacgatattataaagttcacaacagaactacatcataagaatcacccaaatgaaatcgtgactgacacaccttctattaaaattttctcttctaagttcaatgaatttagacacctgaaaggattagtgagttatctaaataccgataaaacttttacttgttattatttcggatttccaaaactagaccgatttataagattcataccttactattataacaacctgtttatcgagtattaaaaatttctctgcaatcatcaacgagtttctccataacaaatatatttaatgttttaacacagatcatataatgctcttactcgagaaatataatattatacaaatttttctctctaaaataagaacattgagaataaaacaaaaaaaccaaaggtctataacctttggtttcttagatgcggccgagaggacttgaacctccacgggttattcacccactaggccctcaacctagcgcgtctgccattccgccacgaccgcgtgtatgatgtgctcatatattcataagtgcactgtttgaaaaaacaatgcgggtgaagggacttgaacccccacgtcataaagacactagatcctaagtctagcgcgtctgccaattccgccacacccgcgtgacaatggtgagccatgaaggactcgaaccttcgaccctctgattaaaagtcagatgctctaccaactgagctaatggctcatctgctatgcagaaaaacatataaaaaaatggctgggctagctggattcgaaccaacgcatgacggagtcaaagtccgttgccttaccgcttggctatagcccaacgaatgaaaaaaacaaaacatgacccgtacgggattcgaacccgtgttaccgccgtgaaagggcggtgtcttaaccgcttgaccaacgggccataaaataatggcggagaaggagggatttgaaccctcgcgccgcttgcgcgacctacacccttagcaggggcgcctcttcagccacttgagtacttctccattatggctccgcaggtaggactcgaacctacgaccgatcggttaacagccgatagctctaccactgagctactgcggaataataagacatgtttcattatatatatgccagaaaaatgtgtcaagaatttttaagcgtttcattcctgcttcatttgcgacggcttttataatttaacatatactaatataacagtcaagcctttttccatgccatttgtttaacttggcagaaagcccccgaccttcacgtagaccaagggccttgatgcagccatcctcatgagattaagacagatgaaactttcgcatccacttataaaaagtacttcttggcactcctgctaacctcgctgcttctgacacatgacctttcgttttatgcagtgcgtctatcactgtttgcttttgaatgcgttccctgaatgtgagttcttttgaagtctcgggttgctctgctggatgcagcttctgttttttctgatcaatcgtctctaatacttgagcatattgcgattcaccaatccatccgcctttcggaaagaggacccttagatgttcaaacaggttaaaaagctctcgtatgtttcctggccaatgatacgcctgcaatttctgaaaaaatgattcaggaaacactgcattccagtgatgcttcttttggtaataacgatataaatcatgaatgtcttcttttctttctctaagcggcgggatgttgatcggatagacatgaagacgataatacaagtcttctcgtatttttccttccttcagcagttcgttcatattacggtgagtcgctgtaatgattcgaatatccaaaggaatttcgtgtgtcccgccgagcggtacgactgccctttcttctatcaccctaagaagcgctacttgcatcgcatatgggatttcgcctatttcatctagaaagagtgttcctttatgggcttgttcaaatttccctttagctccgtgacgttttgcccctgtaaaggacccttcagcatagccaaacagctcactttctaacaggctttcaggaatggctccgcaattaacagcaatgaacggccctttatgcctttcactggcggagtgaatggctctagcggcgagttccttccctgtccctgtttctccccaaatatacacatgagcatctgtttgtgccgctctcttcatctcactaagcgtctgttgaaacaccttacttgttcctgattccccgggaaattgagcaaaagaaacggtcatgctgcttttcgctgcttcttcaagagaaagggatatgcctagcaccttcccgtcttgctcagattgaatgatctgctttccccgaataacaaatgaatgatccttaagccgatcgacatccattccataccagtctgaaaatcgatctctaatcgacctgctggcagacacaatttgctttttttcattacagaccacatacggttcgtctgcttccacctgctggagacaatgagtgatcagctccatctctctccttctttgctggacttgaatttctctctctatggcataagcaaccgttgaagccattccaagcataaaagggtgcttgttatccgtcatacaggagatgtcaatcacccctatgattgtaccgtccgcatcgcgaattggagcagcagaacaactccaatgatgagaggcgatagaaaaatgctctgttccgttgatcgtcaccgcttcaccgatgacgagtgccgttccgatcgcatttgtccctacatctgtttcagtccagcgtgaaccctccataaaattaattcttcttgcttccaccatcgttctttcgcttcctgtcagacttagcacataaccatctgcatcgatgagtaaggccagcatatcagaatcttttaattgctgattgattttatttaagtaaggaagagccgcatttaggaataatgaatatttctttttttgggcactgaatcgttccttttctaacaacgactgtcctttatctaaatacggattcacatttgcctgtttacacctatgccatgattctgccactctcttattcagacgagactgatcaagcaaaccttcacgaacaaaacgtttccacgtatttaaataacaaggcgtcggattcattccatcctctcctctgggggctttttattcattatagataaatataaaagcgctttcaattatcgttggctaacccaagaagtcaattggatagaaaaggagtctttttcagcagtgcaccgctcgtccaatggtttgcagcacggcttcgtgtattgcctctgaaagtgtcggatgtgccgcaataaactgctctaatgtatcagcggtcaactctgcatgcatcatcaccgccgcttgtccaatcagttctgttgcattcggtccaatgattgaaacgcctaatatttcttgatattgcggttctacaatgacctttacgtgaccggctggttgatttaagattaatgcttttccatttgcagaaaatgcacatgtcccgatccgaatctcctcatattgttttctagctctctcttcatttaaaccaacactcgcgatttctggagaggtgtagatgcacctcggaatgacttgctcattgacctttatatgttcacctgatgcatgggatgccgcaaccgttccttcatgaaaggcagtatgagcaagctggaccccacctgtcacatcaccgcacgcatagatatgcgggagattggtttgcatatgttcattgacatagattccgtttctatcaaattcaataccaacctgatccaggttcaactctcctagctgcggagttctgccaatcgccactaagcaaagatccgactggatgtcacaccgctctccttgattattctccaccactacttttcttgaagaggaatcaagctgtttgactgcggcggacgtcaaaatgtttacacccgtttcttcgagctgttcgtgaagacattgtgcgatttcccgatcttcttcgggtaaaatgtgcagagcccgttcaatcatgacaacctttgatcccattctgctaaagatgctcgcaaactcacagccgatcaccccgcccccaatgatacaaagtgagtctgggatcgaagaaagtgacatggcatccttactgtgaatgatccattcgccatcaaaaggtgcaaacggtaaagcagcaggcgcagcccctgttgcaataatgatttgctttgcttgaatgatttcagactttccttcactttctatcaatagctcatgtgctgatagaaatgaagccttcccatttaccacggtgactttgtttttattcatcaaatagcgaacaccatcagtgagctgcttgacgacagactgttttcgtttttgaacggccttccattgaatgataggctcatgttctggaagctcaattccaaaatgtccagctgatttcacatgctcatacatatcggcgctttgcaaaagtgctttggtcggaatacagccttcattgaggcaggtacctcccagctgaccttgatcaattaacacaacctccctgccaaaacgggcggctgttatggccgccacataacctgctggtccgcctcctataatgaccagtgtcatggtacattcaccttcttcctataaaagaatggatattggttcttctaagtgtgctttaaccgttgataaaaatgcagatgcaggtgccccgtccagcacgcggtgatcgaacgtaagactgagtggcaggatggtccctttgctcaattcatcctctcgataaacaggggtgtcatacattgctccaacgccaaggatccccgcttccggcggattcaaaattggcgtgaaatgctctacaccatacgctccaagattggtgatggtaaaggtagaacctttgatttcgtcatgaagaagttttccttcacgtgcttttttgccatacaatttaatgcttttcgccagctctatcagcgttaaccgctccgcatgctgaatgaccggtacagccaatccgttatctaacgcagcagcaatcccaagatgaacattctcaaaagtttcgacaacaccgttatgatattgactgttcatcgcaggatgttctagcaacgaaaggatcgctgctttggctacaaaatcggtgatggtcaactttgtctcgtaacgtgcgatggctgtttcattcagctgttgttgtaggtttttcagttttgtcacgtccgctttcatcgtaatggttaattgtgcacttgtttgcaggctttccatcattcttgaggcaattgttttccgcatcatgttaataggctgttgcactgtctcgttttgtttcttctctttccgttcaggaagtgcacgaagcacatcctctttcgtaattcttccacctggtcctgtccccaccagcgtatcaatgtttaggtttgcgctattcgccattttacgggcaacaggggagattttctttctctctttctttggttttgactggatgtctctatctttcttttcctccacttgttcatttccttcaccgatatagcagatgaccgtgccaggcggtacaccttctccctcaggcacttttatatccaaaatggttccttcagcaggtgattcgatctccatttcaattttttcggagttgatgcttgcaatgctttcccctttgtttacggtctcaccgacctctttattccagacagataccgttccttctttcatcgacatgcctagtttaggcatcacaacttcgacagccatctccctctctcctttctctagttcaagatcttgtcatgactcttgccaatcatctctaatacggtgttcacaactttatcaggtgttggcagatatatatcttcaagaggtggtgaaaatggtacaggagtatgaggagccgtcacttttttgattggcgcgtcaagtaaatcaaatcctttatctgcaatcaaagaagagatatctgcggcaattccgcaccttggatttgcttcatcgacaatgacaagtcgattagttttttctactgaagtcagaatggcctcttcatcgagcggcgacaagcttcttggatcaattacttccgcttcaataccttgtgcagacaattgctctgccgcttcgagtgctgtatacacttgtttgcccacagcaaagatggttacatcagaaccttccctcttcacatctgccttaccaagcggcaatgtgtaatacctctccggcacatctcctgtgatattgtaaagcgtcttgtcttcaaaaaagatgacagggtcctgatcctcgatggctgccagcagcagccctttggcatcatatggtgaagaaggcacaactactttcaaaccagggatgcttgtaaatagcgcatacaaactttgtgaatgctgggcagctgctctaaaacccgccccatgtgtcgttctaatcgtgataggcacctctgcttttccaccaaacatgtatcgaaattttgcgccttgattcagcacttggtccaaacaagtaccgataaaatcattaaacatgagctccgcaattggtcttaatcctgttgaagcagctgccatagccgcacctacataaccggcttcactaatcggtgtgtcaaggacacgctcacgtccaaattcctgaacaattcctttcgttacaccaagaacaccgccccatgcttcatcatcctgtaagtgatctacatgagcgcctcctgcaacatcttctcccattaaaatgacatcttcgtctcttctcattgctagtttaatcgcttcattcaaagcactagacatgctgatttctcttgtcatttccctctcccctttctgatttattgatacgaaacatatacgtcggtcaataattcggattgatctggatattcactttcctcactaaatctaacggcttcctctatcgcttctgctacagccgcttcaatacttgatatctcttgatccgttagcagctgctgctttaataattcttttttaaaaagagtgatggcatctttttcttcttgatgttcgtttttttcttgattggttttgtagcgctgggcgtctccttcaaaatgaccataattccgatatgtcatgcattcaatcaatgtcggaccttctccattttttgctcgttctatcgcttgttctgctgcttgataaacggctgtcacatcttttccatctacttgaatacccggaataccataactggcagctcgatccacaatcgatttgcagcttgaagcataggaaaatggcgtcgcttccccgtaaccattgttttctgcgatgaaaatgactggcagtttccagatggcggcgagattgattccttcgtgaaaagtcccttgattgttagcaccatccccgaaaaagcaaacgcttacattatctgtctttttatatttagctgtaagggctgccccgcacgcaagtggaaagccgcctcccacaattccgttggcaccgagcattcctttatcaaaatctgcaatgtgcatagatccaccttttcctttacaaagacctgtggcttttccatagatttctgccatcattcctttaagatcacagcccttagcgatacaatgaccgtggccgcggtgggtacttgtaatactgtcttgttcattcagatgagcacagactcctacagcaacagcttcttcaccagcataaagatggacaaaacctggcaagatcccttttgtaaaaagcgtgtgtacttgatcttcaaattggcggatttcctgcattttttgatacatccaaacggctttttcttttgtgagtgccattttcatgataaaacctcctatcttttttgcttgcacttctatacaagcaaaaaacgtgccaacatcacggcgcttaaaagcttaggctttgagcgattcacatcgatcaaaaaagagacaaaatgagacttgcgtctctatttgtctcaatatgtctacttcgtctcacaaaaaaaagcatcccataaaggaatgcttatcactctgaaccgattgtacgctgccattttaattttcctttgcagacaccgcacacataacgagaggtatcaactcgccttttcctgataaaatattgtccgcatcctgtgcagacatattcttgccgcttctgtacacgccgtttattttgtaaggtcttgagcggtgtacaaaaacgcggggctcctacttgttttaataactctttaaaggagcggtcacgatgctgatagccttttccctcaagatgcagatgataatgacacagctcatgcttaatgattccgattaattcttctcgtccatgttcctctaggtatcggcggtttagctcgatattgtgtgttccaagtaaataccgcccgcctgtcgttttgagacggtcattaaaaacagcctgatggcggaatgccttcccaaagaactgctcagaaatatgttctgttaactgctgtaactcgctctccttcaatcaagatcgttcctttctataaaaacctcgaacgggacaatttcccctttgcatacattgaaggtacacccactgtttcgatcaaaggaggaatgggcgatgcccaactggctgaaaaatcagatgcagaaggcttttttcgaaaaaaatcattaccaaatcaagttgctgaatcaatgctggtacttctacagaaaaaaacattcagtcgcatcaaggcacaccccatcctgaggtgcgcctcgttttttgttttactctggtttcagcatggagagggcaacgcggccttttgtctggtcaacggagtccacccatacagtcacaatgtcaccaactgatacaacgtcaagcggatgcttcacaaaacggttgctgagcttagaaatatggacaagcccgtcctgcttgacaccaatatcaacgaatgcgccgaagtctacgacgtttcttaccgttccttgcagttccattccttgcttcaagtcctccattttcaacacatctgttttcaaaagaggttttggtacttcatcgcgaggatcacgctcaggtcttgtcagctgatcgatgatgtcctgaagtgtaatgatcccaatatcaagctgctctgctgcttcatccagctgaacctctgcgattttctcctttaactgctctgtgccaagatcatctggcgtcatcttgatcatgcgtaagaactgttttgtttctttatagctctcagggtgaatgcctgtccgatcaagtggatcttgtccatctgcgatgcgcaggaaaccgatacactgctcataagtcttagcaccaagtcttggaatgtcctttagctcttttctgcttgtaaatcttccaatctcttcgcggcgcttgatgatattccctgcgacagcttttgaaagacctgacacatattgcagcagcgcctgtgaggctgtattgacgttcacaccgacttggttgacgaccgtctccactacgaaggttaacgagctgtttaattgcttttggctcacgtcatgctggtattggcctactccgacagacttcggatcaattttcacaagctctgctaaaggatcttgtaatcttcgagcaatggatatagcacttcgttcttcgacttgcaggtctggaaactcttctcgcgccagtgcagacgcagagtatacacttgctcctgcttcattcacaatcaaataggagaccggctgatccagctcttgaatgaggtctgcaatgaattgttcagtctctcttgaggctgttccgtttccaatcgcaatgacttcaatgtttgatgattgaatgatctctttcactttttgtttcgcttccgattttttctgcacaggcgggtgcgggtaaatgacgccgatatgatgaacttttcctgtatcatctacgactgctaacttacagcctgtacgaaatgcaggatcgactccaagtacacgcttccctttcattggcggctgaagcagtagttttcttaagttttcagcaaaaatatgaatcgcttgttcttctgctttttctgtcagctctttgcgtatttctcgttcgatggaaggctggataagacgtttatacgcatcgtcaattgccgcttcgataaacggtcttgccgtcgtctgtttgccttttatgacttgtttgtcgagatagaaacgaatattttcagcaggcggctcgatggctgcctttaagatgccttctttctctccacgattaaccgctaatatacgatgaggcactatctttttgatgggctcttgataatcgtaatacatttcatagacatttttctcatcgctttcgatgtcttttcctgatgtgattaggctgcccttttggtacgtttcgctgcgaatccatttccgcatatcaggatcatctgccagctgttcagcaatgatgtgctgtgcgccttcaagtgcctcttctacacttgttacttccttttcttcgttgataaaagaagcggccttcttctcgatctcatcgcttggcagtgtgagtatataatccgccagcggctcgagtccttttgctttggatacatttgcttttgttttacgtttttgtttgaatggccggtataaatcttcgacctcttgcagtttatgagcctgttcaattttttgttttaattcatccgttagtttgtcttgttctgcgattaaccggatgacttcttcttttcggttcatgacattttggatatatgtatagcgctctgatatggtttgaatttgcacctcatccagtgagcctgtctgctctttccggtaacgggcaataaacgggacggtgttgccatcctctaagagcttgatgacactttcaatttgttttgttgaaagctttaattctgttgcaatttgtttcaataaaaagtcagatgtcttcatactttgcatcctctcactgtgtcttctcttttagtgtatcaaaaaaaccggtaaaacagaaaaaaggtcagctattttacgtgagctgaccaagtacataggtgagatcgtccttcttgtcttgtgtgtatgtttcaagctgtttggcaatgtctgcaactgaatggctatgctttaaacacattctcatgtttggcacattcagtccgtctgaatacataatgaatgtcgatcctttttcgtaggaataggtatatgttttatattttctaggtttccctgataagtatcctgatgtcggaagtggataaatatagtcgccagaaggggcattcaagatgaaccgaatattaccaaccgaacaataggtaaattgctgctgggaaaaattcacctttaatatggctacagtggctccgcgtttatttttcatcgcctgattgcatctgtcaatgagtgtcgtcatatcctcatgtccatattcttcgacaatttcgctgactaaagaagatgattcattggcgaactgaccgctgcctaatccgtctgccacagcacaaattagttcttcatcatctgctttaataaaaaaactgtccccgcagcatgatttcccttctttattcgattgatagatgatggcattcacatgctcatgctgttcaatctgcttcattaccctagctccatagacgcatcttctgataatgcatctcgtagcttcttaactgccttccgttgcagtctcgatacatgcatttgggatatccctaataaatcgcctgtttctttttgactcttattttgcaaataagtcagattgataatctctttttctcgatctgtcagaacatgaagcacactctcaagcatcattttttggttgacacgttcgtagccctcttcttgtgagccgacaacgtctaaaatggtgactgtacttccttcagaatccgcctctacgccttggtcgacagacagtgcttgatagcttttgcccatctccatggtttccagtacttcttcctctgtcacatctaggtattctgcaatttcttggactttaggtgacttttgcgtctctgttgttagatgatcaacggccatcttgattcttggtccaagctctttgattcgccttggtacatggacactccacgttttatcccgtaaaaagcgtttgatttccccgataatggttggaatagcaaaggcttcaaatgatttaccgacgagcggatcgtatcgcttaatggcgccaagtaaaccaatcattccaacttgtctgaggtcctcatgaaagctttttccttttgaatatttttttgccagcacatcaaccaagtttgtatagcattcgaccagcgtgagctgcgcctgctcatcttgattggattgatagctttggataaggcgatccacttcatctttagttagtttcatagttttggatggttgtgtcatggtcaactcgctccctgtttaaaaactttgtcatcgcaacggtaactccggagtttgcttgcacctcgacttcatccatcaatgtttgcattaagtataaaccaagacctccttctgccaattgatccaccgtatgagcagttgtatacggtccgaggtcttcctgcttttgtttaaagtcaaagctaccgcctttgtcagcgacaatgatttctagacgatcttcgtagacaagaaagcgaacagctacctctccatcttcaccgtcttttcctttataggcatgctgaactgcatttgtacaagcctcactgacggcaatttttaagtcttcaatctcttcgtagacatagcccattcggctcgctacgcctgaaagagtcaggcgaatgatgcctacatattctggttttgccggtattttcatctcgattagatctactgattcgttcattgtaccccaccctctgtctttgcagaaatgtcaatgatgtcctttaatccagtaatttcaaacaaccttacaagccgatctgacaagttctcaagctttagtgttccacctgctttttgagctgctttaaacaacccaacaaatacacctaatcctgtactatccatatacgtaacatccttcaaacagatctctagatgctctcccgcctcggctttaggcatgagtgtttctcttagctgaggagcagagtacacatcgatttctccactgacactaattttcgttttttgatctatttgatgctcttttacagacatattcattatgcattcacctcgaaattcttgtttccttgaattttatatacccgtctatgcactttctaaaccttccttttgaggacaagtaacgtaaaatcatcatgcagctgaaaatcttgcagcttgagtaagctgtcatagatggcatccaccatttcctgagctgaataggataggttctctgatatcagcgctttgatatcctcgcgctctaagaagccgtcctccgatttggattctgtgacaccatcagagaataagatcaccatatctcctacgtccaaatgcttctcatactgcttatagtcaaaatctggtgcaattccaagcacaagcccttttgcatctaaatcgtaaaattggttctctttattgcaatagaaaaagcccggctcatgaccagccgatgcatatttaaattcatgtgtttctttattatagctgccataaagcatggtgataaacatacttgggtctacgttttgctcgacaacacgattaagggtctttagcactttagttgggccgctccctgactctggcaaggaatccatcgcatatttaatcatcgacatacaaagcgcagccgggattccctttccaatgacatctgcgatcgcgatattaatcgtatcgtgatcagtcacaaagtggtaataatctccactcatctgttttgccggtacacttatcgccccaatatcgaacgtatctccttctggaattttcgtctccagaagggtttgctgaacattggcagcaatttcaatttctgatttaatttcttgctggatgcctctaagtgttaaatgttcctgataggcaagtccgtacccaatcatgacttcaattaagaagtctagtgaatgaaaaacatctttcggcaaatcagggtaaagctcctgaatcacttttcggtgaacactcactatttcttcaggaggtatttgatgctcaatggttttacggctaaatttttgagcttgataaagcgatgtttcagttaaatcactgatataacgactgagcagctgatggtaccgctgctccattacctccttaaaatccatggtttccctcctagcgaagccacttaacagcttgtatctccgttccttgttctggtgcagaatctaatttaaattcatccatcaatcttctgacgcccggcaagcctgctccgaggccgcctgatgtagaaaatccgtcttccatcactttacgtatatccatgatgccaggcccctcatcggctgcgatgactttgagtccacgctttccgcgctccatcacttcttctatacagatctgacctttaccagcgtataaatagatgtttcgagctaattctgaaatggccgtcgtaattcttgcttggtcaactgttccaaaaccaagttcttttgcaacattgcgccccaattgtcttgctgcgactatatcccattccgtcaatatctttacacaggattggtctttcatatctattcccccaattcccgcttcagtgtctcaagcccttgttcaagatctagtgctgtctgaatttcttccagcgatataccaagttcaatgagcgtcacagcgactgccggctgtattcctgttaatacaacttttgcccccatgagcttggacatggtgatcacatcgcctaatacctttgcgataaatgaatcaatcatatcgacggatgttaagtcaatgacaacaccgtttgctcctgtttcatgaattttattcagtaagtcttcttgaaagtgaagagctgtttgatcatcaagctcccactgtattgaaatcagaagacagttatatagttttaagattggaatcttcgggtgatttctcacttggtaatccctccaatgaaacaatttttcgatttgtcatttccaaagcagtttgaattcctttttgaagggtattctttgttgtaacctgagataaatcaattccaaggttcacaatggtttgggctatttctgggcgaataccgacaagtaaacacttcgctcctactaatctcacagcctctgacgcttgaataatatggtgggccaccattgtgtccacgacaggtacacccgtgatatcaattaagacgacctgtgagcgatgtttgacgacaccattgagcaggttctccataatttttttcgcacgatctgtgtcaattgttccaacaagcggcatgacggtgatgtgctcaaatacagggatcagcggggcagaaagttcctgcagcgcaattttttgaaggctgacggttttttcccatgagatggaatactggtttaagatctcgttatgaatgggtgtgatgaatcgatcgatttgccagatgaggtcatgactttcttcttttgtatctttgtcatcgttcattttttcatataaatgtgtacggatttccgttaggccgtttgccagtaacttaagtgatatacccatttgaacaatttttaaagcaagagtttgcactttttcttcaaactcctcattatacccctctgaaagagatgtaatgatgagttgaacatactccgaacagatggtttcatacattttgtcgttcagcatcatgtccgtttctttttctccgagtcgttttaaaatgtccgtccactctttttctaattccttttgatgctttcttgcaaaagctaacacgatatgattcgacatgttttaccccctacttacatttaaagcaattctttagtctttcttcattataacgttaataaaaattgaacacaaaaaaagttgctcccaatagagcaaccaagtctcaccatattaaaaatcaataagagccaaactaacttgtaaggcttcatcaaccttctccatcatctcatcatcaagatgtgtgattttatctgtcaatctttgtttatcgattgtacgaatttgttccaaaagaatgacagaatctcgttcaaagccgtaccgctttgcattaatttcgacgtgagtcggtaatttcgctttttgtatttgggctgttatggctgcaacgatagcagtcgggctgaagcgatttccaatgtcattttgaatcaccaataccgggcgaaccccgccctgctcggagccaacaacaggagataaatcagcaaagtaaacatcaccgcgtttaacaatcaaatgtttaacccccgctgactaatcgctcaactgtattctcagcctcaaactctgcgtattgtgcttctgaagagatattcagattaattttcgccatctccatgtagccgcgtctcatcgattcacgattttgtcgaatattacgttcacgaatatacgtttttgtcgctcggtagatcaattcatttcttgttaccttatcctgctctgctactcgttcgatctcagacattaaagtctccggcagtcgaatcttcatttcgtttgttgcgctggattcagacaaaaaacatacacctccacaaaacttacggataccgtatcgatccattccaagactaatcataccattattcaatgcacaagcaaagctgttttttcatgatttcttattagaacatgaagcggctcgccacccgtaaatcaagatgataatggagttcctccttcccattatacgcctttttccgaaaatcatacggtatttccaaaatctctaaaaaagggagaatgtttaccctacttttgtcgaataaaaaagaacgaagtcagtttgactatcgttcttttgaatgtgtttataaaaaacttggcccgccttggaggagcgggttccgtacatgcactcttttgccgtcttctatatatactcttggaacacggtggccaatcgagcacgtgacttcatagttaatggtttcaagccttttggcgatttcatcgactggtatcatgtcttctccttgcttaccaattaaaacgaccggctcccctactggaagcttgtctttcagttcaaccatgaattgatccatacaaacccttccggcgatcttccggcgctttccgccaacaagtacttccgttcctgccagcttccggatccatccatctgcatagccaactggaaccgtgccgatccacgtatcttgattggctgtatacgttgccccgtagctgacactctcacccttttgaatgtgcttcacatgggcaagttttgtatgaagagacatagcttcttcgagcttgaaaggcagttcatccttgatttcttctgacggcgacagcccgtacatactgatgccgaagcgaaccatattaaacaagacgtctttaaaccttagacctgctgcactgttggcgcaatgaacgagcagcttgtccgtatgaagcggctcaagcagtgtttgaaaggtgtcgacctgccgatcaaagtaggcctcatccttttcatctgctgtcgcaaagtgagtaaatacgccttccagctgtaaataagagtgctcgctgacaagctttttcacttcgttcacttgctcaatcgttttcacacctaatctgttcattccgctgtctattttcaaatgaaatcgtataggctgtcccatctgccctttcatcatgttggtgacgtctctcagccaatcgatggagtatgcagtcatgatgacattgtatcgaacggcgactttgacatattccggcggtacagcgccgagtaccagtattggtgctttgatgcctttatttcttaaagaaacggcctcatctaaaaaggcgacggctaatacgtctgctcctgctttgagagcagctcttgccacttctatatctccatgtccatatgcattggctttcaccacagccattagttgaacactttgaccgatatgatctttcatatgtgaaacattatgcttgattgctgataaattaatttctgcccatgtgtctctataaaaggcatttgtgtccatccgtcacacttccctattgaatgattcaatcccctcatatgatactaaaaatcaggaataaagtgaaacaaatcaaagaacatcagcccttgtatagggctgatgtttcatttctaaggctctcgcccgaggtatttatttagctgactggccttctacactctttgcaaccatcaagagctcttccttcgatagatcacttgaagaaatcaagtagtccactccgtcagatgtccatgaaagggattgatctgtcagaaccccaactgtcatgccaaggtcgactggctcgccgttcattgtcacaggcgtagatgcttcagcgactctcgctttttcctgaatgagtgtgaaggatttctttccgccatacgtcatcacataacgcttcccggcatctgtcatcatttctttctcttccatctctttcacaccctctggcatgtcaactggtgttttcaccgcaaagctgtcagatgggtctgcacttgtggcaacatccatttgagagagtgtcatgtttttcttctcatcaaatgcatctttgtcgaaggatttattgaattcaaagtgagagaattccactttcaccattggctttttgtcgctatccagcactttcacactggcaggcgccattgtttttttatgaaagataatctcttgggtaggcagcatttggttgtgctgataattggttttggtttcgaacacatactttgaatctttcgctttgaactgagcggcactgtcattcttaatatccttcacgagcgactcaaataagtagacctgactgctattatttggccaatcactgtggaaacggaagctcttgttcaatgaaggtgtcagcacaaacacaccattgccatttcttaaaatgacttgactctgatcctttttcggattttctaaatagacacggtaaagttccggcttcttgtaccaaatttctacctgatactcctgcgggtcatttcctgtctcaatggtcatttttgctttggctttgtatgatgtcatttcctctgcctttttgtttaaatctccaacgatatccttctgagatttttgaccgcatgcggagagaatcagtacaaaaaggattcccgttacaagcaaaacaaagctttttctcacccttttcaaccccttcgttaattgtgttaaaaggaagaaaccgcttgtttgactttaacagtacgcctcaagagttaactgcgtaccgcgaaccatcaaagcctgttagcaactcgcccttccttatcgcactacccaatatatgaagaggggacaaacaatatgcagactagcttgacaacctttcaattaaaacttgtgctgcagcatattctttcgtgtgagtgatggacacatgaacctgatcacccttcgtcttttcgcttttgatgaagggttttccatgttcgtctttttggatttccatgtcatgaaagcttaaatacgagccgattcccgttccgtatgctttagcgaaagcttcctttactgcaaaacgtcccgccaaaaattccagctgcctcttttcactaagtgcgtgaaagatgtcttgttcacttaacgttaaaattcgttctggcaaacggggctgtctactaagcacgcgcgcgagccggttaatctctactatatcaatgcctattcctttgatcatgaggtacctcctatgatactcgtactaatttggatgttctcttcataaacgtgttactataaacttaccattatctagtcaaaaggggtttgttatgtttattcgaacggagagctttcaacaatttattagatcgtatccaatcgtcacaacgatccttgctttgcaatttggtctatggcttatatttgcgcttcctatccctcttatacagcttggtcacgaccatctcgtcggtttcaattatggtgtagctgctggagaatggtggcgactcgtcacacctgttttccttcacggaagtctgacccatattttgttcaattcaatgtcattgttcttattcgctccagcgcttgagcatttgcttgggaaggttcgatttctgatcatctatcttggtgcagggttcattggcaatctcggaacctattgggtcgagcctttagagtatgtacatgtcggcgcttctggtgcgatcttcggtttgtttggcgtttatttataccttgttctatttaaaccgcatatgatggaccgcggcaattctcaggtaatcttaacgattcttgcagtctctgtcatcatgacgttcgtcaactcaaacatcaatatcatggctcacttatttggattgatcggcggcatgctcctagcacctcttacgctatttttccattcaaaaaaaagacactattaacctcataaaaaatgtcgatcactcctatgaacaggaagcggatcgacatttttgtgtttaagttgatttgtttttttcatacgaataccaatccattacacgtgctgcatcttcttcctcaaggtgatgcacaccaaacgaatcaagcagcgcagaggatttcacaaaggtgtgaatacttgccacccggcctttcttttggaagaaagattgcgtcatcgtatagttttgcattcgttttctcaagacaatgccagtggttttgccaatgcctcttgatgtcagttgaatcaatggatctttgatcgtatagcctgattgtttataagctaaatagccaaaaaccaaagcaataggaagcggaatgagggccaaatacccccatggcggaaaacggacagataggatcacgccgacaagtaatggcacaaagccgaaagagatcaggtagcgcttgagtgaacgctttggcacctttttcagctcagattctggctccaaatgataatcatctgtgaattgagagagcagttcgttgatttttttcttccgaatcagtggaaataagacggaagaggtttctttttctgtaatagaacctcctgcactcacaagcatcaccgtcgcaaagccaaagggttcacgaagaatattttctttgattttcactgcttgaattctcgcaagcggaatggtcatttgatgcctttcgatgagccctcttgtgatgatgatgtctttcccttttcgttttgcgttaaaattcgcatattgaagggctgttaccccaacactaagaatccacgcaatcaatacggcaataaatatgagaatcgcataaatctcaatactcgcatgacttaaaaaagaaaaccgcttgacgaatccgtccaaaggaagaatttcatctatttgtgtgtaaatggcgagacacccagaaataatgactccgatcccgcttgaagtggtcgcagccaaaagcagctctggtatacccatccggtaggaaacattgatttctttttctacaggttgctgcgctttcagaggatcatgcgggacagctccattttcatccaccatttcttcttgctgcaagcttttcttccgattgaaaatcgattgctttaattgttccgcttctgcttttgtaatcgccgtcagactcacttctggaccgtctgttcctccagctgtttcgatttgaaccctcaccaaaccaaaaatccgctggaagataccttcacttgtattcaccgtttgaattcgttctaacgaaatatattttttcttttttgtgatgacgcccgattccacacgaaattcatcatcttccattcggtaggtgaagcgcctccatgctaaaacagttaaaacagctttccataaaagaagcacaccaagaatgataaatgcataaaaacgaatgctcgaattcgagttcacaaaaataagcacgaaaaaagggataatgaagtttttgatcatggatacggcatctgagataaaatcaatgaacatcgagattggatgtacacgttttggttcagacatcatcttccgtcacccttgctaaacgagatatgtaatcacgaagctcatctgcttcttctaattctagcgccggtatatcatgaactgtggcagcagtcgatatttgaacagatgccaaacggtagcgccttaaaagcggcccttgtgatgtatcgacatgctggacacgcaccatcggtacaatcacacgtgtgacacgaatgagcccatgctgaatttcaatttcattttcgaatacttcgtagcgccagatgcgatgacggattttcggtataagccaaatgccaaaaatgacctgtaagacccataaaccggcgaggatggccccaatccaatatggccattgaagataataactagcaacaaataccccaatgatgatgagtaagaaaatcaatgagataattccattttgaagacgccatacctttaaaccatttaaactaatttgacgttgcggctgttttctcacattcttcccccattctcttacttttctatcaatatattacgaaagaaagcctaaaaagtttcagtaaacctgttaaaaaaagcgaaccctgcaaaggattcgcttttgaattagttgttataagatttcttttgacggcgatcgctagaagaacgattgcggtcatttgaagaacgctttttatcaccgtaagatgaacggcttttcccgcgatagccgccgcctccgccgccactctctctacgtttagaagagctgcggttgttacgattgcgttttgaaaccattggtgcttcatctgtcaaacgaacaggcgttgcatccggttcttttgtcatcattttgatggcagccgcaaccactgtgacagaatcatgatcttctagcaattcagcagcagctgtcatgtagaagtttaagttgttttcactgatgatggtgcgcagacgatcaatagttacttgctgttgaccttcaattgcttcatctagagttggttctttcatacgttccattttacgtttagtcgtttgctcaatcgcacgaagcatatctttttcacgcggtgtgatgaatgtcaccgccatacctgtacgtccagcacgtccagtacgtccaatacggtgtacgtagctttctggatcttgtggtacgtcaaagttatacacgtgtgttacgcctgagatatcaagtccacgtgctgcaacatctgttgctacaagcacatcgattgaaccttctttgaatttacgaagcgcaaccatacgtttcgcttgagtcaagtcaccatgaattccttcagctgtataacctctaaggttaagtgcttcagtcaattcgtcaacgcggcgttttgtacggccgaagacaattgaaagctcaggtgattgaatgtcaagaagacgagtcaatgtgtcaaatttcttacgctcgtggatatccaagtagaactgttggatgttagagacagtcatttcttttgcttttacttttacgtgttctgggtttgtcatgaaacgttctgcaatgcgcttaattggtgcaggcattgtcgcagagaataaaagtgtttggtgttcacttggtacatttgaaaggatcgattcaatgtcttcgatgaaacccatgtttagcatttcgtctgcttcatcaagcacaacagtttcaacattttgaagacgcattgtacgacggttaatgtgatcgagtaaacgtcctggagtccctacgatgatatgaggatttttcttgagcgaacggatttgacgaccgatatcttgtccaccgtaaatcggaagtacgcgcgcacgcttgtcttggccaattttgtatagctcttcagatacttgaatcgctaattctcttgttggcgcaatgataatcgcttggatatttggagacgctgggtcgattttttctacaagaggaataccaaacgctgcagtttttcctgttcctgtttgtgcttgtccaatgacatctttattctgaagaccgagaggaattgtttccgcttgaatcggtgttgcttcttcaaatcccatgcggttaatagctttcatgagactttcgcttaattgaaaatcttgaaacgttatagtcaaattattcaaactccttctaattgctgtttcagtaatctcgtgaatgatcattaaaaactgcccttttctgaaaggacaggtccattatatacaaagcccgaattaccctaccttatatcttaccattacactatttgtttttcaacaagacagaaatggatatatctactgttccacaatgacagattcaccatcactttgatcgccatccatccatttccacttttcgaacagttgaatttttccgttatccaactgattaggtgtagaattgcaagacccgcttctcatgctgccgtctttgctgacatggtggtacctaaaatgaagtgttccatcctcatttacagttcctacaagtacaccagatacaatactgccgccttgatacgtgcccgttaatatattcccgtcctgacgatattgaaatatggtgcctaccgatacttctccgttactcgaattagactgcgggacaaaggtttttccgtcatattgaaacaaccgaatcaaccaccttttctttcctattgtaccataggcttgtcactcattcgacaaaaatgatgtaatttttaacaagtgggattcaatttatattagtttagccacattttcgcttttctatagattaaattgtttttttaagaaattcctctactttttcaaacaattgctgtgcacatggctcgtgacaaacatgatgtttacaatcaggtaaataaaacatttctttctgacgggacgggattttatgatcaataaattgtgcactagaagctggcacaatcccatcgctttccccttgaacaattaacacagggaggtgaagtttctcaagagagctcttcgtttgcttcaccagcttcataaattcaacagcggctgacagcggtgtgctcgttagcttatgacggtatctatcatacaaagggttcgtatcaattagcccagacaatgattctttcaccatctgccttgtgtcttgaatcatttgttttggattcacatatttcgccgcagcacttaaaaggacgagacgagcaactggatacttcgctgcaagataagcagcaatcattcctcccatagaaaacccgatcaaaaaaatggtatcacatgttcggtaaagagaaagaagttctaattcagctgtcgcaatccattcttgatagagaataccttttagctgaagttcatctccatgccccggaagcgtgacagactgaacgttccaatctgtcttctgctttaaatattgcgctagcggttccacttcatagggggcgccagtaaatccatgtatacagagacagccaatcattctgtcaccttctttgccgctctctttttatagtgcagtaatgatttcttctaatctcatgccgcgtgaggctttgacgagaacaacatcgtcaggacctgctacgtcagcaagttttttcttcagttcctctttgtccataaatgagaacacacgcgcatcaccgaatgatttctttgctccttcagcgatgaatgcacctaggcggccatatgtcatcacatgatcaataaattcaggcttgatgtagcggcctagttcataatgatacgtttcttcttcgctacccatctctagcatgtctccaaggacaagaatgcgatttgcgaagccgtccatatctcctacaagatcaatggcagctttcatggaagtagggcttgcattatatgcatcattgataacagtgattcctttttctgttttaaacagttcaagacgcattcctgttaattttgtttgcatgagtccttgggcaatttgtctttcattcagtccgaaatgctgacctatggcaatggcagcaagggcattcttcacattatgtttccctaatacaggaatgagaaacccctgggcatacccttcgacctgaaattcagttccttctgcaagctggttgatatgcgttaccttgatatcacagtcctctgcttctccaaaggttttcacttgctgcgaaagtacagtcgctctctcgcggatcaagggttcatcacctaaataataaaaggtgccatcctttttaagcccttttgtgatctcatattttgcatcagcaatggcttctcttgatcctaaatcttgcatatgagattctccgatattggtgatgactgctgcatcaggctcagctaggtttgacaagaactcgatctctccttttgcgctcatgcccatctctaatacagctatctctgtaccttctggcatcgcaagaatggtgagcggaagaccgatatgattattaaagttaccgtctgttttatgaacttgatacgttgtttgtaagacggaatgaatcatatctttcgttgtcgttttcccgttacttcctgtaataccgacaacacgagggttttcttcttttaaatacgattttgccaattgctgaagtgctgccagagtatcatcgacaagaatgacaggtacgccttccggtggattggtttctttttgattccaaaaaacagctgcggctccaagctccactgctttagaagcaaatgtgtgaccgttaaaatgttctccaattagggggataaacaatgcaccttttgatacttttcgtgtatctgttgtcactccgtgaatttgctcttcgccaaaagcttgattagatagtgtcccaccagccatttgggcgatttgtttcactgtacgtttgatcatgatttttcgcctctctttctcatttcacgtttgaaggaaaagagacactacctaaggatagtgtctgcttgttgctcacattaaaaagtcgttttaatggtttgtttttcttgatggcgttcaattgcaagtgacactagcttttcaatgagctctggatactctacaccagtgtgcttccaaagcagcgggaacatactgaatggtgtgaatccaggcattgtattcacttcattgatcaacacttcgcctttttctgtgaggaagaagtctgcacgtacaagaccagaaccatctagggatttaaatgccttaatcgccatatcatgaatcgtcttgtattcataatctgacacacttgcaggaatgatcaaatctgtatcgccatcttcatattttgctttgtagtcataaaaatctgttttaggtgcaatttcaccaacgacagagcatttcggctcgtcatttcctaatacaccaatctcgatttctcttcctacgacgccttcttctacgaccacacgacgatcatattggaaagctaagtcgaatgcggtttgcagctcttctttgctacggcatttgcttattccaacacttgatcccatgttggcaggttttacaaagcatggatagccaagtacttgttctacctgttctaagctgtctggtgtggctttctcatagtcttttttattgaaggaaaggtgcttcgcttgtgcaagtcctgcttgagcaaaaacatctttcatcatgactttatccatacccgcggcagaagcaagaacgccgttgccgacatatgggatatttagcagttcaagtaatccttgcatcgttccatcttcaccatttggcccgtgcaataatgggaagacaacatcaatcttctcatcagcggatgcaggctgtggaaacatgctctcatttaaagaagttggtaaaaacgccttagcattctgttcaaattgaagcattctgacgtttgatactggttcagtgagtttttctcctcttagccattcgccctcttctgtaatataaattggatgtatatcgaacttctcagtgttaagtgcttttgtaactgcaagggctgtttgcagtgatacattatgttcggctgactttccgccgtaaatcaatcctaaacttattttcaatggatactccccccactaaaattcatctttactatcttatcactttcaagcaaaaatgctctaattaattttttgttgttacggaattgaaatgatttgtaaagttgtaagcgcctcccgagcatttgtatgtcattcgcctttattttatattaaaatgacattgaaaaggagttgtgacaaattgaaaaaaatcacaagtactgaacaattcaatgaaatcattcaatctgacaaagaagtcatcgttaaattctttgcaacatggtgtcctgactgtacaagaatggacatgttcattccagacatcttagaggcatatgctcaccatgaatggtttgaaataaacaaagatgatttccctgaattagcagaaacgtatcaggtcatgggtattccaagcctgttaattttcaaaaatggcgaaaaaacaggtcatttacacagcgcaaacgcaaaatcacctgaagaagtgacagagtttcttcaagggcacgtttcttaaatcgtgaaacgaaggacatcagcaaccacttgctggtgtctttttttctccatcccttacatcaaatctcctcataagacgatttgatcaatcaaaacgtttcaacgagcgaaagaatgttttatatagatgcttctcttaagacaagaaatgacaggaattatttcctgggaaagaatgagcgtcgactaggcatcgaatttgtcgattacgtgaattttctgaatataatctttacttccgacattgcgctttgtataatagaggtgctaattgaaaatgattatcaatttcatctatgtgggatcctatagacgtctattcttataaaggagcgatgagtcacatgtctaagaagaaaatcaaaacgtatcagcaattgattgaagagaacaagaaagccatcatgcgcgaccctaaaatgatggaaagtatatacgaaaccatcgacaaaaagcatcagaagcagcttgcggctgctggacgcgaatcataaacataagggggagcagtcaaagctggctgctcctctcttttgtcttttccaacaaaaaaagccgataaaatctatgctttgattttatcggcttttgttttaatgtgatttcgctacacggtcctgcttcattcctaaataaatgagcatatatgtgagataacccattgtcattgttaaaccaccgaagaagaactgagaaaagacaggctcctcaaatgttgtgacagcagcaagaatgatccagctcgcatataaataaaccatgaaccatttcatgttttttttcagtgtatacagaaagaaaagacccgctaacgaaaagattcccagcgctagtctgaaataaataagatgatcaaactggaaggcaaaagacacgaacgaaaacgatagcagcaacaaaataggtaaagccgtaatgaaatttttcacgatagtgccacctccaagactccctcttattataagacaaaatcagccggttatcgtgaaatgcagactcgttttcacaaagatgtcacgaatttttcttgttatttgacacaatttttacacatttacatcgcgcttccaaaaaagaacccaagccgtgccaacaaagaaaacaaaatgcgcccctaccataaatagagaaaacaaagggctcatgccatggaagggcggcggtccttgaaagctgtactgagtaaagtccgtattagcaaaaagtaggattttcccccactgattttctaaaagagacataataggcacaagtgatttagccgcatataaaacaaaaaacgaggtcacaagcgcaacgaggctgttcctaaacaagctggaacacataaaagcgaagcttgccatcatcaacacttccacccactgagttccgatcacagcaaacgtatgctgaaataatcgtcccgtactttcgtcaaatgcagtaccaaagaaaataagaccaaataggaaagcaagtacataataaaaaacaaacaaatagatgaccgtcagcacaagtgtgatgtattttgacaggaaaatttgcagcctagttttgggccgtatcaataaaaacttgatcgttcttttttgaaattctgttgagatcaaggtcgcgccaatgacaactgcaagcacctgtaaaataaatacgacgtttgtggaataagcaaaatagttggcgacagtgtcttgtccaccaaagctggaaatgactcgtttcaatgctagagccatcgccaattgaaacacaacgatcaatccaagtgcaatgaacgtgatctttttccttatcattttcttatgctcattcttgatgagttgaagcatctgccgtcccgccttccgtccatttcataaatgcctcttcaattgatggcttttgaggcgtcatttcaagtacatcaaatccagccagaacaagctgtttgttcagctcaggcacttgctctttgttcaattgaagtaaaacatgcgatccatttcgttcatatgtatagtcatgtgtctcgagccacgtcactgccttttccactggctgaatattcatgagcatctgttcttttccctctatgtcccgaagcatggcactggctttgatctgtcctttttgaatgatgatcatgcggtcacatagctcttctacctcatgcaataaatgtgtagcaaataagacggacgttccttcttctcgtactaacgattgcaagtgctccctgaattccttcataccggcaggatcaagtccatttgtcggttcgtctaaaatgagcaggttcggctgatgtaatatggcttgtgcaatcccaagcctttgtttcatccccagtgaataggtcttcaccttctgatgaatggcgtgctccagacgaactcttttgaccacttcctgcattcgttcctccgtcactccatcgtgcatcgccgcatatagttcaaggttttcaaagcctgttaaataagaataaaattcgggattttctatgattgcaccaacagaggacattgcgcgtaagaaatcctcatcctgtgaatatgcattgatcatgatgcgcccgttgttttttttcatcaagccaacgatcaaacgaatcaaagttgtttttccagagccatttggccctagtaagccgacgatttcccccttccctatttcgatcgatatatcttgtaaaatcattttccggccaattcgtttatcgactttctctacttttagaacagcagactccaacgtggttcctccttctgatgtaaaacctttggcggcaaataaggccactcattctgttaaaagtatatcacgcaagacaaggaactccatgaaaaaaagggctgatcgagtcagcccttcttttacattacatggatagattcggtgatgcttcgtctttctcgtgttttttctccgtttctgtcacaatcaccgcacatgcggcgtcacctgtaatattgacaacggttcttgccatatctaataagcggtcaataccaaggataagcgcaatgccttcaaccggaagcccaaccgaatttaataccattgcgagcataatcaatcctactcctggtacaccggctgtcccaatactggctaatacggcggttaatacaactgtgagcatttgcatgagcgttaactccacaccaaacacttgtgcaataaagatggttgcaaccccttgcataatggctgtcccatccatattgatcgtagcgcctaaaggctgcacgaaactagaaatcggctcaggtactttcaatttcttttgagcggtttccatagatacggggagaaccgcactactgctagacgtactaaaggctacgaccatcgcaggcgaaaagtctttaaagaatgtaaatggatttcgttttgcaaataaagccaaagttgagccatatgtgagaaagaaatgcaccaatagtgctactaatacgactgtaaaatacagccccatggctttaatagcctcaagaccttggctcccgatagccgtcacaattaatccaaatgtcccgtatggagcaaatttcatgaccactcctacaaggtacatcatgagttcattgccttgttctaatattttgagtattccttctgtttttttgcctagcactgcaattcctagtcctaagaatacacagaaaacaatgatttgcagcatatttccttcaactaaagattgaactggatttgatggaatgatgtttaataaagtgtctgtcgtagatggtgcttcttgaggttcgtattctgcccctttagtatcgaatgaaccaaaggaacccggtttgattaataatgctaatgacatcgcaatgataatagcgaaggttgtggtcagtagaaaatataagatgctttttgctccaatacgccccagtttttttggatctccgaggcctgccacaccaagtgtaatggaaaagaagacgattggcacaaccagcattttgattagatttaagaagatttgacctagaggtgtgaatagataaggatctaacactttgaatacatttggagcgaaaatgttaagcaaaagtcccgtgattgcacctacaataagggcaataataatttttgtcgccagcttcaataaaatctccccttcctcgtcaaaaagacccacgagagagttttctcgtgggtctgcgtgtccttacatataccaccgtttactctcttcacgccgatgaggttagctgacgggttaggacgaagagatgtccttttttctcaacagagaaaaattcaccccaaaaacatgggtcccccattcctttagaaggattaagcgtgtggttattatgatattttcatactatttataccttatttttagaaaattgtaaacaggttcaaatgaactttttaactactttcctccttgttggtgacctccaaaatatctaggataaacacaaagattggtataccaataataagaccccatatcccgatgtagtgttcagagaagatcagcacaacaaatgtgaagaaaatagggagttctgtttttgctgacataagctttgggtttaagaaataggcttcaatcgcatggatgatgacgatcacaagcacgatatacaggacatacatgccgcccccaagcgtatacgcaatgatgctgagtggaataagtgagatgaccacacctgccactgggattaagcctagcaaaaagaccatgactgctaatccaaataattgcgggaatcccataatgcctagggcaatggttgttaagacacaattaacagttgcaataataaactgtgcttcgagaacctttccaaacgttctggagaatttacgtccaaagaaggcgatttcatggtagaacacagagattttactcgttttgaacttgttcatgaattgaatgaggcgttctttttcgaacaggaagaacatgcttaatattaaggacataatgacctggatactgaacgtactgaaatctgttaagtatgtatagaggaaattaaaccctttctcaaagtaagctgatattttaaaatctccgaatacgttggtgatgacatcaaagaagggtaaattttgtggatgatctgcaattttctttcctaaatgaaatagttgctccacctgtttggcgatgattggcacaaacacaaatccgccaaacgtcaatccaccagccaaaagaatatacaaaatggtaataaccgatttctgacctattttcaggaagtgacttaaaaagcctctaatgacctcttctaaccgattcatcaaaaaggtgaatatgaaggtcaagagaattaaattcatcattcctcttaatagatataaggctgtggctaatactacaaatacagaaaaccgcttaacaccgggtttttcgaacaattttaaaaatgctgccattacgttacacacctgccaggactaaagtctatttttcattggatctgatatacattatatcggatctttctgtaaattatataacaaaaggtcaatgaggtcttacgattcgacctaaatttatcaagctttaatgttttttcttttcaacacaagaaaaaaccgaacctcatgtagaacataaggtttcggtttttggttgtttttatactatacagcttgctttatattacgcatttcttgaagggctgttttgctcttcgcttcgtcaaattcaccttcacttttcgccacaacaattgtcgcgattccatttccaatgaggtttgtgatggctcttccttcgctcatgaatcgatcgactccaagcagcagtgcaagcccctctagcgggatgacctgtagtgcagcgagtgtagaagccagcacgataaatccgcttcctgtcaccccagccgctccttttgatgtgagcatcagaacaaggataatggtgatctgctgaccgatagataggtctacaccaaacacttgcgctaagaagaccacagccatcgataaatagatcgaggttccgtctaagttaaaggaataccctgttggaatgacgagtcccacaacagacttagaacacccgtagcgttccattttatccatcattcttggcagcacggattctgatgagcttgtgccaagaacaattaaaatttcatccttgataaatcgcaggtaaccaagcagactgaagccatacattttacaaatgatgttcagcacaacgaagatgaacaggaacatcgtcaaataaacggagagcatcagacttgcgagcggtttaattgatgccaaaccaaaatgtccgatcgtataagccattgccccaaatgccccgagcggcgctgcacgcatgatatatccaatgattttaaagaaaaccagtgacagcttatcaagccactcaatgattcctttccccttctcgccaagtgcagcaagcgcaacaccgaataaaatagagaagaataagacctgtaaaatatcacccttagcaaaggcatctaccatattagatggtacgatgtgtgtgacaaattccatccagtcgataccctgtcccccattttgggtatactgcgaaacgtcccctttttcaagcttactatagtccagacctgcacctggcttcatgatattgacaacaaaaagtccgatgaccaaggcaagcgtcgtgacgacttcaaaataaataaatgcttttcccccaacttttccaacctttttcatatcccccattttggcaataccaagaacaatggttaagaaaataattggtgcaatgaccattttaacggcattgataaaggtgtcaccaagcggcttcatttcttttccgacgtttggccaaaccatcccgacaatgatcccgataatgacagctgcaaccacctgaaatgtcaggttcttcaaaagcctcttcataaaaaatcaactccctcaccctttgatgtaaacgcttaactgttatctgtagctaaatgatagcgatttcaccaaagactgtgaagcttatgaacatatcgtacattttggtctttttggtctcttagtcagaatgtacgatatatttattaacaggccggccaaccccgccatattgcatatctaatttcagctcgccttctttcactaagaagtctaaataccggcgtgccgtgacacgtgcaatgccgagtgcattggcaacttcctctgcagactgcggaccttcctgcaagctcatataggctttaatttcattcatcgtatgcacattcagccccttagggagccaagtatcttcctgcttaacagcaggctttcgtatgatatcatccagcatctcctgagaaaattctgctgctgtacgaattttagatttaaacgctttatagctttcaagtgattctttcatacgctcgaacttaaatggcttgatgatataatctcgcgcaccattttgaagcatggtgccaatcgtctctttgtcctttgctgcagaaataacgatcacgtccacctgtatcttttgctttctaatgtcttgaagcgtcttcacgccatctttttttggcatatatacatcgaggacaacgaggtctggacgaatttctttgatgagctggatgccctgctccccattacctgcgattgccgccacttgaaagccaggaacactcttaatgaactccttattcacttcttgcaccatcggatcatcttcaattaatagcaccttaatctgagtcatctgtctctctcctctatgatcattgggaattcgattgagaaggtggtaccaatgccgatgcttgatgtgacttctacatttcccatccctttgtcgataatcgtttttacaatatacaggccgtagcctgttccgccttctttgccgtgtgtgaaacctttatcgaaaatataaggaatcatttcctcttcaatcccagagccattgtcttcaattaaaatcgcgaggacatcctcggtttgatcaatactaatagacatgcgttttgtgtctctttctacagtatcataagaggcaaaggcattctcgatcaggttgccaagcagctttgtcatatcatgctgatccagccgctcagggaaatcacacagacagctatgttcgtctacttcgacttttatgcctagctccttgccccttctgattttactcatcaataatcccgcaacggcatcatgctgaataacgcggtgaagaaagtccagcacatgttcttgctcttccgtcgtttgaaaggctagatcaagtgcctgatcgggtttaccaagctgaatcagcccagcaatcgtatgaagcttgttcatatgctcatgattttgtacccgcagaccgtcaacaaagttcttaactccggttagctcctctgccaattttgccgcttctgtccggtcctgaaaaatggcgaccgctccgataattttctttttcatgacaatcggaatcctgctgctcataatccgctttccgctcatatgaatttcttcattatagacgggctcagcgcgatcaataatctctggaagccttgtgtcagacagcacaccccaaatattcctgcctacgacatcccctgtcacgccaaatatttgcttcgccttttcattaaaaatggtgatcatgtgctgattatcaatggcgataaccccttcattaatagagtgaaaggttgcggtgcgctcctctagcattctgacaatctcatgcggctccagcttaaacatttgctgtttaatatgacgagcaagcaaaaatgaacctacaagcccaaagctgagcgtcagcaaaagaatcatgaggatatcccgcttcatttctcctaatatatctaccatacttggcagtgttctccctacaaggacgacccctgtttgattaaattggtcatccttcactggataaaaggctctgatggctgtcccaagctctccctctgcttctgagaaataaatgtgctcggcaaaagcaggctcttcatctgtcccctccgagcgctggccaatccttgttttcactggatgcgttaatctcacatgatccatatccatgacgacaatgtagtcagcgtcttgaataatccgaatctcttcgatggcatgctgtaatcgatcacgttcttttgtttgatcagctaatgcctgctttacctcattcatctcagccactgttctcgctgtgttcatgagcctttttcgaagctctcgttcctctgtttgctggattcccccaacaaggacaattcctccgattaaaagggcgaaaatgacaacgaaatatgtgaggatggtgagcttccatctaatagataattgttgtaatttcaatcgatttctcatcatttttttcacctgtatctttacgaattcttcctcggtcaagtatgcttgacataagggggatcggacgcatgaagaatttactcgcctatacactattgctcttgatcggttttgtaaccgctttatactttggcttttatcatatgatgccaaaagcagcgacaacctttgacgatgaacagacagggctgaaggagcagcttgttttcaaatttagccatgtcgtggcagataatacaccaaaagggcttgccgcaaagaaatttgctgagcttgtgcacgaaaaatccgatggcaagatcaccattcaaattttctccaacggaagcctttattctgatatagaagaaattaatgcactcaaagagaatcaagttcaatttatcgcaccatctacctcgaagctcggcatgctatcccctgagtggctggcacttgaccttccctttgctttttctaattatgatgcggttcaagaaggcttgcacggtgcaattggacaaagattgtttggcaccctgcaaaaagacgggctaaagggaatggcgtactggacaaatggctttaagcaaatcacctctaataaagggccaatcaaacagcctaatgatttaaaaaaccaatctctccgcattatgcaaagcgacatgattgaaaaacaattcaaacttcttggcgcaaagccctatcaggaatcgtttaattcgacgttccagctactagaaacaaaaaaagtagatggtgaagaaaataccatttcaaatatttattcaaaaaaattctatcatatacaagactatatgacgatcagtaatcacgggtatttgggctatgtggtcttaacagatcaatccttctttgatcgccagacacctgagacgaaacgaattttacttgaagcgatggaagaaacaacagcttggaatgaaaaacatgcagaacagatgaacaaggatcaactggaggacattaaacgggaatcaccgattgccattcatgaattgacaccagcagaaagacaaaaatgggtgaaagccctcgatcctttgtatgaggaagccgaaaaaaccattggttctaccctaatcaaacagattcgtgagctgcgtgcgcgttatgaacattctccgatccatgcttttcaagaagaggataagaccaaataaaaaatccctttgagtaaggggatttcagattgttgacaaagggctaaaatgatcttgattttagccctttgtcttcttttcagcgtgatagaaaacctttgcagccctaggaaggacggctacttttgcggagcgaatttgacattcgtaagcaccagcgtgcaggactgataacgaatgcgagggtttgtctacacgccgcgttatgcaccagattcactctgttcttgctgcgtgagctcttctaatcttgaagcaattcttcgctttcggtattgcatcatgcctgtttcggcaatactttttagttgtgagcggttggaaactgcgccaaataaaatccctgctactggaacaaactgaaacagcttcttccagccaaatgaatctcggtaattatagactacctcacgccacccttggatttgcgagaacatgttttcatgtttcccttcggaagcatgatagcttctgagctcttttaatatcgattttttcccaaccacatcagcagaggtcagctgtaagcattttatgatgaagacccgttcttccttgtttttaggatcatagccatatgtgacggcaatatcctgtaatgttttaagggagagaccaagtaccgcaggaatatctgcagccagtgtaaacataccaccgacacccgttgtcgccccttgtaccgtggcgagatttgtcctatttttccccatatgttcactaatggcatccatgatttcaattggtgctttttcaatatcttctatacgctgaatggaatcatcggcacatttcttttgaaattgatggatgatgcctttttctgatgtcaaataggcacctcctgattgaatgtaatgccccatttcatctagcagcacaccaatttttttctggataaaggcaggcgtcagcttgtccagcatttgaaatggcaggcggctgagtttctcccaaaaccataccttttgctgatctttctcccactgttcaatctgctttaattgtgcttttagccactctctttcctccatgcctttttcctccttagatgctgctgaagtatttgtttgttattatacacaatccttttccatcatacgtatagaacattgaatcggtttcgaaaggtttgaaactttttcaaaacggttattgcttaatacacaaacaaaaagaggagtgatcaacatgttaggatttctgatttcattagttgtggcgattgtcatcggccttattggcagtgcactcgctggaggtagtgtaccaggaggatggatcggttcaatgattgcaggacttgcaggtgcttggattggtcatggattacttggaacgtggggtcctagtttggcaggctttgcgatcattccagcaatcataggtgcagcgatctttgtcatcatcttaagcctgatcttccgtagtgtgggatcaagggtatcttaaaaaaacaaataacagaggaaacagtagggacaccgtctaaaaggcggtgttttttatgtgttggattgacaaggtatctatttttttcacttacatatgataaacaaacctattagttcagatagttgacttttcataaagatgggcatatgatgattaaaaattgcatcaaggaaactttttgtgcccaagcaaaactttgtagaatctaggtgatgacatatgacaaacaaatacatcgaggcacaggcatacatgtcagaggcagctgagcgtgcacttgaaggaaaagtcaaagggtttagaagactccttccttttctcggtcctgcttttatcgcagccattgcgtatattgatccaggaaatttcgccaccaacattgcggctggctccaaatatggatatcttcttttatgggtcattctcatatcaaatctcatggctttgctcattcagtccttatccgcaaagcttggaatcgcgacaggtaaaaacttacctgaaatcgcacgtgaagaatttccaaagcccgtttcgatcggtttatggattcaaggagaactcgtcattattgccacggatttagctgagtttattggggcggcacttggtttatacttactctttcgaatcccgctgcttgaagcatccattatcgcggcgatcggctcatttgcgatattggagctgcaaagacgaggatatcgagcattagaagcaggtattacaggcatgctatttgttgtcgtgatcgctttcgctgtacaaacctttgtcgccaaaccagatatcgcaagtgtcgctagcggattgttcattccaaaatttgatggcgcagacagcgtgctgcttgcaactggcatattaggtgccactgtgatgcctcacgcaatctacttacattcagctttaacccaaagaagagttgtcggcagaacggaaaaggagaaaaagcagattttccgctttgagtttttagatatcctcattgcaatgatcgtcgctggggccatcaatgccagcatgttgattgtggctgccgctttattttataaaaatggtctctttgttgaagatttggatgttgcgtttcagcattttggtacactcgcagggcctgtatcagccatcttatttggtgtaggtctgcttgtagccggactctccagctcttctgtcggtacattgtcaggcgatatcattatgcagggctttattcaataccggattccgctgtatgttcgccggctgattaccatcattcctccgattgcgattattgcatctggagtgaatccgacctccgcgcttgtgatgagtcaggtcgttttatcgtttgggattgcctttgctctaattccactcattttatttacaagtaaaaaacgaattatgggagaattaacgaatgcccgctgggtgacaggaatatcttgggtgatagcagctcttgttgtagcacttaatctcttcttaattgtagatacgtttatgtaaaagacagtgttgagctgtctttttctttccatttggttatggtagaattcccctgagaggatgtgggttcatgtttgtttatcaggatcaagagatatctatgcggctgcttgagccaagagacgcaagaagtctgtatttgctcatccagcggtcgagagagcatttacgtgaatggatgctttgggtggattccacacagacagaagaagacagtatggcgtttatccaaggtgcgatgcagcaagcgatgcagaacaacggttttcaagcgggtatttggtcacatggagaacttgtcggcatcattggcacccatcaaattcattggatcaatagaaccgtttcaatcggctattggctcggagaaggctatcaaggaaaaggcatcatgacaaaagcatgccaagcagtcattcgctatttatttgaagagtgcgggctgcaccgtattgagattagggctgctgtcgataaccagaaaagcagacgcatcccagagcgattatccttttcgcttgagggaattttacggcaatgtgaatggctgggcaatcgctttaccgatcattgtgtgtacgcccttttacagcctgaatatatgaaacaaaaaacgcattcgatgaatcaacccacttaattgtgtcgattgcatgaattattttacaaagtgaagctttgtagtatccgttgtgatcggcatctgataaaatagaaggaaaaatcgaggtatgatgtatgtctcttattattttattttacttatggattgtccctttagtatttggtattttcttctcattcctaacaaagaaagccacctacaaacgccgctttgtcccatcctatagcatgataggactcagcatcgtttttctcattctggcactcgtcttttcagccagccattttctatttatttgcggtatgttcctatttgccaccacactagttggcacaggcatccccttattcttagcctttggaaaaacaccatcctaaacaaaaaccaccttttcgcaatggaaaggtggtttcttttttattgaagcggcatccggtatgtcattgtggcatttggatgttcttcaatcgtcttcatcatgtcttgaaggatctcggctgcgcgatcatttgagtcatacttgccgagcatctttgcccaagaagtacttcctaagatcatcccttcaatttttttgccgcttactgagacttcttgtatatgaattagagtttgctggttttgtgtgaagatccatagcatggttttttctccttttttgtggtggttggattagattaatatatgatttccaattatgtgtggagtgatttggtttgctttttattagaaatttcacccgtattttcattttcaagtttctcggacatgatacttattttaaggtcactcaatgttttttcctccattgctttcaaaaaaacaaattcactttattcttttatcatatcaatctttacatgctttgaaagagaacgatggacaattagtccatcgttctctctctagttatttaaaaattaatttcttttctgtctctaaaaactcttctacaagttctttaattgtattttttgaatcatgagggtaataaaatgcgtctgaaacttttctaaagaagtcatacatattttccggtgtattaaagattgaaaaaatattttcaatttcttcaaagatttcttcatcacttgagttaatatacgtctctttcatagtgctatatagccacttatgatattctcttttcatgtcttccgaagaactgtcagaggttatgctttcaagtatattatctactttaacttcttcttgttcccaagctaattcaaggattaattcattattagcattagggttactttctaagtatttaacagcatagtttgttacttctaaagcagaaattaaattaaactgtctaccaacaagcagcgtagaccagttacaatcaaaaccatttttcgtgattatttctattttatacaatttctatttcccccattgatttatttttcctgtcactttgcccccaggtataaaagttctatgggtcactgtattcgttgttggatctaccacccattcaaacacgccattccttatttctttcgactgtaacatttcaggggcattgttctttacttttacatatttcgtttcgtacttaaccactgagccctctatttgatacaacgaatccatatggccttttctatttggtaaatcaaatctcttagaatgaactgcgtagttgtcaattatatcattaaagctatgataaaaatcatctttcaatgcactacctactcgtggattttctaaaactggatgcttaagttccctcgtattcttaatccccatcttcccatgaaaccctttcgccccaaacggcaaaagcattccaagcgctgcgttcatactcgcttcctgctgttcttttgagaccttattaccaaacatatcacggcccgtaatcgcttcgctgaagccgttggtggcggtgaggccatataagcctttttgagatgtttttaaggcgtcaaaggatttttgcgatgtcttgtagatgtcgactgctctgactgcggctgacgtggcttgagtctcatcttcgccgttcttagcggctttaataatataacatttcgcttcattttatgtcaacaacttttttcaagtttatttcccgaagcgttttgtgtttgtcactgtgtgtcagcgacgattaataatatatcacgaaaacattctatcggtcaacgccttttcaaaactttttttgaaatagttttattgtgcatctcaaacccttgtcctgcatacaatcaagtaacaatctcggacaagtcaggagtgtttgaattgagtcgattatatgtgttgccaattaaacggctgaagcaagttgtcattattcttgtagcagcccttgcagctgcaacctttttttatgtacaaaaggcaccgccgctgtcggtatttaaaacagaacatgggccccgagccatttataaaggcgagacttcctcaaaacatgtctccctgacttttaatatcggctggggagatgagaaggcagtcccaattttaaatgtccttcgagagcacgatataaagaacgctactttctttctgtctgcttcttgggccgagcgtcatcctgatatcgtcaaacaaattagagaggacggccaccaaatcggcagccttggctatgcttataaaaattatagccagcttgaagatagtgaaatcaagcaagatcttgtccgggcacaaaattcatttcaaaagcttggactagatgacattcaactattaagaccgccaactgggcaatttaacgaaaaagcattaaaaattgccacacagtacggttataccgttatccattacagcgtcaattcacaggattggctgaatccaggcatcgatcagattgttcggaatgtaaatgatcgaatgaaaagcggagacattgttctcttccatgcctcagattcagcaacccaaaccgctcaagccttacccgctattttgaaacaaatcaaagagaagaatttaaaaaatgtgacggttggcgaactgatctccaataccaaaacaaggtcatcggaagttaagtagctttcgcctttgaaaaccgcggcatagctaataactgaaacgcattacagcctaatagcgggaatagcattaaatacagccagtcctcttcgttaactctaagcgccgggaaccattctagcgacgtgatgacaaccatgagaaacattgcggaaacaaatgttttcttagaggactgctgctgtttaaagtaagccacgatcaatgcgaacacaccgataaagacaggcagccataggtatggaagaaatgattcattctccccgaaaagcaaaaaccgcaagtaagctaaatcaaacagcacaaagatcaccagaaacagctgaatggtattccataaagaatgcgaccggaaaatctctaacgcaaaccggtgcaccgtcaaaaagacaacaaaccccatctggctaatgacactaaaaatcatccccacaccaatgaaccaaaacaacacagatgcgatttctagaatgtcaaacgatataaaaagcttctgatatttcccccactccagcgcaaagcctaccacgcttgtaatgaccgctccaacagctagcacagagaagaaaaaacgaactaaatcccgacttttcattgaattgatccaacccctatttttgttatgtataaatttacgtgaaacattcatattaaaagtaagacatgtatcgaaaggagccacagtatgtcaaaaggcatcttgcgtataatgagctgttttctccttttatctctaacagcttgtgctcccaaaacccaatcctcatctaatatggactatgacgaaacaaagaaaatggtcgtcgatatattgaagacagatgacggtaaaaaggccattcaacagttattaaatgacgaggcaatgaatgaagctttggtaatggatgaacaaactgtgaaaaaaacgatagagaaaacactgacttctgataaaggcaaagagttctggaagaaggtctttgaggattctaaatttgccgagactttcgcaaaatccatgcagcaacagcatgaaaagatgttaaaacagttaatgaaggaccctgactatcagcaattgatgatggatattctcaaggatcccgaaatggaaaagaaatacggtgaactggtcaaaagcaaagagttcagaaagcacttagaaaaagttattacggaaacattaagcagtcctctctataagaagaaattcgaagatgagctgaaaaaagcagcatctgaaagcagcagtgattccggttcacaaggaagcggcagttaaacatcacccgagtggcacaaggtccactcgggctttcattatgcttttactgctaattgttcaataactttattcgcaatgtgttgatacacttctcccgttggatgactcgcatcatagacggatggagcaaaatcatcttcattccaatcaggctgtcttaaagggatctgaccaaggactgatactcgcagctcctccgccagcttgtccccgccgccctttccaaaaacatattccttctcacctgttttcttgctttcatagtagctcatattctcaacgacccccagcacctcgtgatctgtttgcagtgccattgcgcctgctctagcagcaacgaaagcagctgttggatgcggtgttgtaacaatgatttctttacagcttggaagcattgtatgaatatcaagcgccacatctcccgttccaggtggaaggtctaatagtaagtaatctaattctccccactcgacttcgtggaagaagttatttagcattttaccaagcatcggccctctccaaatgaccggtgcattttcttcaacaaaaaagcccattgaaatcactttgacaccaaagcgttccacaggaataattttttcccctttaaccgttggtctgacggtgattcccatcatatccggtacactaaagccataaatatctgcatcaatcaggccgacttttttccctagacgggccagtgctacagcaagattgacagacacggtggatttcccaacgccgccctttccactcgcaatcgctaagaactcaggcggatttttagagttgagcaggttttcttcctcatcttgtgatggcataaacctttcaagagtttcctgaggcagttcttcaaaacgaagccctactgtgttagcgccctctgctttcaaagcttgtacgatgtcttgctgaagcttcatctgctcagcagtgcccgttttggcaatagccacctttaagctcacatgttctttttcaggttttaggctgatttccttgatggcatccagctcaccaagcggtatatgaaggaaaggttcgtccatcttcccaactagttttctcacatcatcttgtccgatcatagcagaacctcaccctttattgaattcgtttacaatccaagtatatcatacatatccttacaatgtctgtcctgtttgcctgcgttcaaaaggaaaaagccccttattcaggcggctctttttgctctgttaaatatcttaaaatgcctttataaatggaggcggctatttgatcttgatatttaggtgttgccagctgaccggcctctttcggattggagagaaatccaatctccacaagagctcctggctttgtgacattttgcattaaatagatgccattgatacgcttcgcctttcgatctgtgttttcaagattattgcgtaattcatcttgtatgaacttcgctgccttttcattctcttcatattttccgtaaaaaaacgtctgtgcgccgctccatttgttcgatgggatcgcatttaaatgaatacttaaatagagatccgcttcagactcattgatggcttttacacggtttcttaaatcctccgctttcttccgcgcatatccctttgtattctttgatgataaatcagaatcatcctcgcgggtcataagaacaagtgctccctgctcctgcaaatagtcacgtatcttcttggatacatccagtgcaatctctttttcaagcagttctcctcctacagccccgccatctggaccgccatgacccggatctaaatagatgatcttgccgctcagaggcaagttccacgatttccacgaatcatcatttagaaattgaaacctgaataagaataagaggacaataaacccgattaaaaaccctgtccatttcagctttcttttcatccctgtccctcccatacaccattattttatagatatgggacaagggctggaaatatgcttagtgcagccgaagcttatgccttttttctgattctcgaaagccttcctgccaccacatgcttaaaaaatccttcgcaaatggatacagacatgacatcttccgctccattcggaacatattcgcccacgattgcaaacaccctgctagctcctcagccagctcatcttcttcttgaactgatcgcttctttatatcatcgaacgattcaccgtacttgcttgactcaccgtatctcccaccagctaaaaaagcttcaatggcgaaatcgatacagccatcactcataatcccagctggatcatctgcaaatgggaacagcttcttcgtgaatttctcagaagcgaccgtcacctgttgaagagacaatgtacgcaacagcttcttttcaagcgtgacatctcgttttgttttcaattgataaaatgaaagaacctctgccatagactgaactccttttttctttgtattgttcgttggtttgaacaaaacatgcagttcagtaaatggaaatcaatgagctaatgggttggaaaattgtgataaaatgaacacttatatagaaagaatgaaaaaggggcaaaattcatgaagaagtggatgtatatcctattgctattaacagtcgtcttatctggatgcaacagtaaggcgaccgagcagaagagcgacataaaaggaatagaagacatatcattaaaacagctttccaaatacaaaaattcctatattggagacaacggagcaattggcgctattttatcaaatcttccaggtaacgtgattcgtgagtatgaaatcatagatgaaaaagagctaaaagtgacatatggcgtgaaagaaaatggcaattatacagaagaacaatttgatacattttggtttgacaagaaggataccattgaaaagaactacttatataacgtattggcactttttattcttatcgataatgctgagcaagtgacactcaagataaactctaacgacaaacaatccgtcacgtttaaaagacaagagctagaaaaaaggctccctcactcctttaaagagtacaaagacgatgcagcgctttggcaaaaggacctggttgatggagttgtgaagacaaaagagaagcgccaagatgtatataaagtgtttcccatgcagaaataataaaacagaggggtgtctccctctgttttttatgattatttagtaaaagcttgaattaattgttgtcgaaagttttggtccactgctgcagtcagtataaattcattgaatacttcctcaatccagtgagaattgtccgctttcggatcattgataaaaagagaaatggatatagatgagatatccgtttttcgatataaagcagcagtgacaacaaacaatgtcgatccacctttataccaaaaatattgatctgtttccgtcttcaatgtttctcccagcacaatttggctaaaaagacgcttttcttctgttgttaacagctcatcctgtagacgtttcataaaatgtgcatattgattagttgtagactttgtcattttttgcgtcagtaatgattgaatccgcaagcttaacaagtcttttttcatcaatttttcttctaacgcctttttatgctctgggtcatttttcatgatattaaaaatctcaatcatcagagatttgtattgtttatcagttacatcgctcaattgcttgaatgcattccgctcatgatcagatacataggctggccacaacagcttgggtgtcagcggcatgagttcatcatgttctgtaagacctgcttgtttcatctgatcattgatcttttctaagtcaagcaagtcaatcaaataatccgtacaagcattcgaactgaattgcatcatccctttggcaacatctagtaaagtcgcatgctcagaaaaatcattgacctcaagccagtacgtgtgtgcaccaccgtctgttctatcaataaaaaacttctctatatcagacaatgccactttttcatctagcttgatgtcaccgctagagacggttttaacaaaatgaaacaaaaccattaatttcatcgtacttgcaagtggtgttttttgatcaccattccaatctaataccacctcttcattttcaatcattgtcgctgatacgtcctttttgtttttcgtgacaaatgtcaaaagatcttcctttgttttattcaaatgtttctcctttcccaaccactatagattctcaccttcaatataacaaatatttgaaataaaggcacaaaaaagcaaaggattatgaatacctttgcttctttgtgtgtttattgacgatgaatttgcagcttcatcccatcatgcgtagcttcaaagcccaacttttcgtaaaaacggcgtgcatctgatctctgtttgtctgttgttagctgaatcatatgacagccgcggtcgcttgcatgttgaatagccttttttatcaacatcgtgccaattccttttcctctatgagtcgaggccgtacgaactccttctattgaagctctccatcctccttgatgtgtaagaaatggcgtcatgttcaattgaagaacaccgactgcttcttcctgatcacacgcaacaatgagttcaatattgggatcagcatctattgaatgaaaggcttcgatatagctttctaataatggttgcgtgtaatgctctcttttttgacctaacatatcatccgcgagcatgaagacgattttgtcgagatcatccagcttggcttctctgaacgtcagttgactgaaccccattgaacacacctcctatgaaattattgaccaaaataccattgatgtgcgttcttatataagatgtgatcagctgccttttcatcaaagagctgttgaatcaactcaacatcaccgtattcaaatggacgctttgctctagtggatggaaggtctgtaccaaacatcagtgcatcaggattcgtttgataaatggacgtcaatgcatgttcaacgtttaaatcgactcgtccaaaaccagttgcttttacccgaacccctttatcaaccagcttgagcaaatgcggcaaaccttcttccgacaagcctaaatgatcaatcgaaacggctggcagctgttcaagcgtagatgagatgtcagggagatgcttagcatctatgtagagctcactatgccatcccgccagctcatacacccttctcgcaaaataatcgagcttcgaaatatcctccgaaccgccccgcttcacattaaaacgtaaagccttcaccccatgttgatccaaatgaacaatctcatcatcagttgccgtaaaaggtaattgagtcacaccgcaaaaggctggacccagttcatccagcgccttcaacaaatagccttgatcaaagccttgaaatgaccctgagacaatggctccacctacaatccccagatcagccgtctctctcctataatcattcaccacataactaggcggtgtatacccttggttttcttgaatgggaaaatcaaaatcaatgatatgaaaatgtgcatcaaagatcctcatgcgcgcgcccctcttctgcttatttgatctgattatatcaatagcgaaagccaagggatatttggaatgacgaattacttcatatcaagaaaacttatcaagtttcccattcctcccgtaagatggcatagtaaaactcatcccaccactcatttccttgtggtatacattttttaaaatatccttctcttctcatccccaatttctccatcactctccacgatggcacattttcaggctgacaagtggcaataatccgatgtaaattcattgtgtgaaagccatgatgtagtacagcataagccgcttcagatgcatagcctttgttttgatatgcaggattgaagacccagccaatttcatatgtgtgatcaccaaagtaaggatgaaatgcgatatgcccgatacatgtatgatcttcttttaaaaggacagcaacatacttagcatcttcatgacgattatttttgacaaaactcttcgcatctcctttagaaaatacatcttccggaatatacttcatcacgaccggatcagatgtatatgcatagacatcctgccaatcatcatccgtaaatggtcgaatgagacatctttctgtcgttagattcataggacaacctccatcttttttaacagaaaacttctatactcatattttatacgtattcaagaggaagagaccagtcatgatctatcacataaaaagtacaaaaaaaagcaccagcacgaagctgatgctttttttataaggtttgtctgtaacaaacctttgtaaaacgtccatacaatataaaattgattaacgttttgagaactgaggtgcgcgacgtgcgcctttaagaccgtatttcttacgctctttcatacgtgggtcacgagtaagaagtccagcacgtttaagtgatgtacggtactcaggatctacttctagaagagcacgagagataccgtgacgaattgctccagcttgaccagagaatccaccaccgtgaacagttacaagaacatcgtagctgttagctgtttctgtgatgttcaaaggttgtttcacgtcttcgattaaagcagcgaatggaatgtattcagtaatttcacgattattaacgacgatacggccttcacctggaactaagcgaacgcgcgctacagaacttttacgacgacctgtaccgtaatattgaacctgtgccaaattgttaacctcccttataattaaccgcgaagttcgtaaacttcaggttgttgtgcttgatgtggatgctcagaaccacggtacacatttaattttttgaacatttgacggcctaatggaccctttggaagcatacctttgatagcaagctccaacattttttcagggtagtttgtacgcatctcaagagcagttctttgtttcaaaccacctgggtgcattgtgtgacggtagtaaattttgtccgtcaatttcttacctgttagttcgattttctcagcattgatgatgatgacatgatcacctgtatcaacgtgtggtgtataagttggtttgtgcttaccgcgcaaaagtgatgctacttcagtagaaagacgacctagagtcttgcctgccgcatcaacaactagccatttgcgctcaattgtgcttgcgttcgccattggtgttgtacgcatgagtttccctcctaaataaatcaatgaattttccttgaatcaaatgctacgttctatttcaaaacacaagataagtcttccggggcttatttgtggggttgaaatacataccatatgatatcttataactttctgcttcctgtgtcaagaacatgttacacctggtttagttgtcatagaaaacttcccataaatacagtccgtgactaggcgcagtcttgcctgccgcttcgcgatttcgggcggcaagcatagcttttatctcatcagggtggaatttaccagatccgatttcaagtaacgttccagcgataattcgcaccatgttgtataaaaagccatttcctctcacacgcatttcaaggccgtctgagacgttttcccactcaagggtgtaaatctccctcaccttgtcctgaacctctgtattggccgcacaaaagcttgtaaaatcgtgtgtgccaatgaggtgcccagcagcttctctcattttgtctgcatccagccggtaaggaaagtggcaggcatactgtctcgtgaacacattttggtgcgtttccgttgagaccttataacgatactccttcgaaacgacactaaaacgcgcatgaaacgattcatccacttcctcagcctttagaaccctgatgtcatccggcaggagactattgagggcaaaaggccatctttccatcgggatcgagagcggcgtgtcgaaatggatgacctgccccttcgcatggacaccgctgtccgtccggccagaagccacaatcggaatcagttcatcctgtttatgcattcttgcaagagccgactcgatctccgtctgtacagttcgctgcccaggctgcacctgatagcctttaaaatgtgtcccatcgtaggatacggtacatttgaccttcatctaggaatcacctaatttctcagaagcacaaggagtgctgttaacaggatgaataagagcagtgtgaacgtgtctttcatgccccagacaagctgacggtatttcgtccgaccttctcctccgcggtagcctctcgcttccatagcagtcgccagctcctctgcacgcttaaacgcactgacgaaaagcggaacaagtaagggaacgatggctttcatgcgatctttaagaggtccgcttgtaaaatcaacacctcttgccatttgtgccttcatgattttgtccgtctcttctagtaaagttggaataaaccgaagagagatcgacatcatgagagcaagctcatgaacaggcagtttgattttacggaatgggtgaagcagcttttccataccgtctgtcacttctataggcgttgtggttaacgtcagaagtgtcgtcatcatgatgagatagacaaaacggagagaaatgaaaatcccctgctttagaccttcttcataaatatttaaaaaaccaaagtgaaatagcaaagcgccatccttagtcataaaaatatgcagaataaaggtaaacaggacaatccataggatcggcttcattccctttagaataaagtatagcggcacctgagaaaccatcaccacaaggagggtaaagacacctaaaagcccgtaagtgatgtaattattagcaaaaaagacaataaagacaataaagaaaattgataacagctttgtccttggatcaagacgatggacaaaggatgtacctggcacatatttgccgataatcatactatccatcatgatgtcgtgtcctcctgataaagagctgttaaggcttctgccatttcatccatggtcagaagcggccttggaaacgtaatacccagcttttcttctacagtctgctggaatttaatcgtttctgggaggtcgagaccaaacgaagacatgtctgtacgattggcaaacaattctctcggcgtacctgtcgccttcaccgttcctttatgcatcacaatcatttgatccgcataatgagcagcatcctccatactgtgtgtaaccagaatcgtggtgaggtttgccttttgatgaagctcatagaacatgtccatgatttccttacgtccgcgtggatctaaccctgcagtcggctcatccagcacaagcacttccggttccatcgctagaacacctgcaatcgccacacgtctcatttgaccgccgcttagttcaaagggagatcgagataataaggattcaggaagaccaaccagcttcagcatttccttcgcctttgcttctgccttttcctgaggaacaccgaaattcattggtccaaagcagatatccttaaggatcgtttcttcaaagagctgatgctcaggaaactgaaacacgatgcctacttttttccggagggactttaaatccttctgctttttattggcttgtaagacggtatccccaagcgcaatgctccccttcgttggtttgagcaagccatttaaatgctgcagcaacgtggacttgccagagcctgtatgaccaatgacagcaacatagctgccctcttggatggaagcattgacatcatacaaagcgagacgctcaaacggcgttttcatttgataacgatgctctaattctttgatcgtaatgtccatagctctttcaccaatccttcttgtgtcaaatgggcatttgcaagcggtacaccttgctgcttcaattgtttgctcaaccgataggagaatggcagatcaagtccaatttgaactagctgttcgtctaattcaaaaacttcctctggggttccctcggcaaattttttcccgccattcatgacaatgacccggtctgccttggcggcctcgtctaaatcatgtgtgatggaaatgactgtgaccgttccttgttccttcagtagtctaacagtctctaacacttcttcacggccaatcggatcaagcatcgatgttgcttcatccaagatcatgatgtcagggcttgcggcaagtacgcctgcaatggcgactctctgcttttgcccgcctgatagatggtgcggctcttgatcaagaaactcctgcatattgacctgtttgacagcccaatctacacgttctatcatcaattcccgctcaaccccgttattttctaaaccaaaagccacatcatcacgaaccgttgagccaacgaattggttatctgggttttgaaagaccattccgacctttttgcggatatcccagacactctcttctttcagctcaatctctccaaccttgaccgttccagcatccggtaaaatgagcccattcagtacacgggcaagtgtggatttacctgaaccgttatgaccaacaatggcgagccattcattttgattcacatgcaatgacacttgatctaaagcgggcttgtccgcatccttgtgataacgaaatacaatgtcctttacgtcaattaatgtcttccccatctctaccggacctcctctcagctcaacctcttctttgcttcttgctaaaaagccgtagtatctaaaaaagggcatagatccagttatgaactgtcccgccctttcttagatacacgctatgtgattaaactaattcaatgacagccattggtgcgccatcgccgcgacgaggtccaagcttcatgatacgagtgtatccaccttggcgatcttcgtagcgagttgcaacgtcagcgaataatttttgaagtgcatcttggtttgtttcagcgttagctacttcattacgaatgtaagctgcagcttgacggcgagcatgaagatctccgcgtttgccaagagtgatcattttttcaactacagagcgaagttctttcgcacgtgtttcagttgtttcgatgcgttcgttgatgatcaaatcagtcgttaggtcacgaagcattgctttacgttgtgcactagtgcgtcctagctttctgtatgccatgtgatgtcccctccttagttagagaatgctgtatgaataaaaaacacacgaaaatcctagttcacaatgaaactagtcaatcgtctttacgaagacccagtccaagttcttctagtttcgctttcacttcttcaagagatttacgtccaaggttacgaactttcatcatatcctcttctgtcttgttagcaagctcttgaacagtattaatacccgcacgcttcaaacagttgtaagaacgaacagaaagatcaagctcttcaattgtcatttcaagcactttttctttttggtcttcttctttctcaaccataatttcagcatgctgagcttcgtcagttaacccaacgaaaatattcaggtgttcagttaaaatcttagaacctagagcgatcgcttctttcggtcctgtgcttccatcagtccatacatctagtgttaatttatcatagtttgtgatttgcccaacacgggtgttctccacttgataagtcacacgagatacaggtgtatagattgagtcgatcggaatcacaccgattggctgatcgtctcttttgtttgcatcagcaggattatacccgcgacctctttgtgcagttaagcgaacacggaagctcgcattcttgccaagagttgcgatgtggagatctggatttaagatttcaatatcgctgtcgtgtgtaatatcagcagctgttacagtaccttcatcttgtacatcaatttcaagcgtcttctcttcttcagagtagattttgagtgcaagctttttaatgtttaagataatcgttgtaacatcttcaaccacgccttcgatcgttgagaattcgtgtaagacaccatctatctggatcgatgttacagctgcaccaggaagtgaggataaaaggatacgacgaagggagttccctaaagtggtaccatatccacgctcaagtggctctacgacaaacttgccatacttggcatcgtcgctgatttcaaccgtttcgatttttggtttttcaatttcgatcatctaataaaaccctccttcaaaacgtcgaaacctcgaatagaatcatatgagattccatccgaaattcctcattgtttagtcccgtatgtgctcaggcaacgagtcgtgtattcgtctcataaataactgtatcataacccattattgacagggacacaaaatctatacaaacaaattacacgcggcgacgttttggtggacggcatccgttatgaggaactggagttacgtctctgattgcagtaacttcaagacctgcagcttgaagtgcacgaattgcagcttcacgaccagaaccaggacctttaacagttacttcaagtgttttaagaccatgttcgatagaacctttagcagcagtttcagcagccatttgtgcagcgaaaggagtagatttacgagaacctctgaatcctaatgcaccagcacttgaccaagaaattgcgtttccatgaacatcagtaatcgttacaatcgtgttgttgaaagtggaacggatatgagcgattccagcttcaatattctttttcacgcgacgtttacgcgtattttgtttacgagcagcagccattctttaactacctcctttacttattttttcttgttagctacagtacgacgcggacctttacgagtacgcgcgttgttttttgtgttttgtccacgaacaggaagtcctctacgatgacggattccgcggtagcttccgatttcaattagacgcttaatgttaagtgaaacttcacgacgaaggtcaccttctactttaagtttgtcaatgatatcacggattttaccaagttcgtcttcagttagatcgcgaacgcgagtgtcttcagaaacacctgcttctttaaggacttgttgcgcagtcgtacgaccaattccaaaaacatatgttaaagaaatgacaacacgtttatcacgtggaatatctacaccagcaatacgagccatgatttgggcacctccttgttattagccttgtttttgtttatgttttgggttttcacagatcaccattacttttccttttctgcgaataaccttacatttttcacagataggtttaacagatggtctcactttcatgtgtttccaacctccttcttccggagttgctttatttgtaacggtacgtaattctaccacgagttaagtcatatggagataattctaccgtaactttgtctccaggtaaaatgcgaatgaagtgcatacggatttttcctgatacatgagccaaaactgtatgaccattctctagttcaactttgaacattgcatttggcaaagtttctgctacagtaccttccacttcaattacatcgtctttcgccattcaagtgttctcccttcttcaaatcagtaacttgctctctgacaaatgtccaaatgagttcatctcaattgtccatctatcacccgacctgttttgaatatactgttctgaacttccggagatacgcaaccataaaggttatatgattgatattttttcttaggagaatgaaatttacgcttttctccgtctgcgattagtacatggcagccaccgaacatgccgatgacacctgtatactgatcttgttctttcctttggactatacagacaacctgcccgatttgggcctgaaaggcttcagtgaagacctaaatcttagtcagtatatcaaaacctgtatctgtaatcgcaatcgtatgctcaaagtgagcacactctttcccatcaaccgttacaaccgtccagttatcagccaatgttttcacatatcggctgcctgcgttcaccatcggttcgatggccaacaccattccaggttttagccgcgggcctttgttgggcggaccataatgagggatttgagggtcctcatgaagatcctgtccgaccccatgtccaacatattctctaacaactgagaaattctcgttttctacatacgtttgtatggcatgggaaatgttcgacagacgttcgcctggctttgcttcctgtaagcctttatatagagattcctctgtgacttccagtagtttgcggtcttcatcgctgattaccccaactggataagtccaagcagagtcaccatgatagccatttaacttcgcgccaatatcgatactaatgatgtcaccatcacgtaaaacccgtttaccaggaataccgtgaacgagttcttcattcaccgaaacgcaaatgctcccgcgaaaaccattataccctttaaaagatgggattgcaccctgctttgtaataaaacgttcggcaatttgatccaattcttttgtcgaaatacctggttttatatgtttcttcagctcttcatgagtcagtgcgacaatgcgtccagcttctctcataatctcaagctcgcgaggagttttacagataatcatttatttaatcccccaagcaggtccttgatatctgcatatacatcgttaatgtgttttgcaccgtcaatgtttgcaagatatcctttttctgaatagaagttcagtaaaggttcagtctgctttaagtttacttcaagtctagtcgaaacggtttctgcattatcatctgcacgttgataaagctcgcctccacacttatcgcaaacattttctttcgcaggtggattgaatactaaatgatatgttgctccgcaatttttgcaaattcttcggccagtcagacgctccatcaaagcatctttatcgactttaatattaatgacataatcaatcgttctgccaaggtcctttagaatgtcttctaaagcttcagcctgagcgactgttcgcggaaatccgtccagaagaaaaccttgctcacaatcatttttgccaagtctttctctaacaataccgattgtgacctcatcaggaacaagctctcctttatcgataaaggattttgcttcgagcccaagttgtgtctcctctttcatagcagcgcggaacatatctcctgttgagatatgagggatcccataatcatcaacaattcgttctgcctgagtgcctttaccagcacccggaagccccattaagactaagttcatttcggatttccccttccttacttagagaggttgggcaggagcccagccctctgttttatttcataaatccacggtagtttcgtttcactaattggctttcaagctgtttcattgtttcaagtgcaacacctacaacaatgagaagacttgtgccgccaatttgtgcagcggaaggtaatccagcgaattgaatgaaaaagataggaagtattgaaatcacggctaagaaaatggcgcccacaaacgtgagtcggtacaaaatgctcgtaattctatcttgagtcattttccctggacgaactcccgggatatagccaccctgcttttgcagattttcagccatttgttcaggattcacttggacaaaggcataaaaatatgtgaaagcaacaatcaatgctacataaatcgtcataccgattggcttagtatagtcaaagttgttggttatccaagttgtcacattattagttccgaagaacgatgcgaccgtctgcggagtaataatgaatgaaacggcaaagatgactggaatcacccctgctggattcactttcaatggaaggtgcgttgcttgactagcagagatttgtgcacggccagttccttttgaatattgaatcgcaatctttctcactgccatttgaatgtaaataacaccgataacaatgacaaggatagcaatgacaataagggcaattttcaggatttgcatgaacagctgtccatctccacctacaaactgctgagcgtacacttgttttaatgtttgagggatacctgcgatgataccggcaaagataataatcgaaataccgttaccaacgccgtgagcagtaatctgctctcccagccacattaaaaatgctgttcccgcagtgagtacgaccgcaattaagaggtacgttgaaacacctgggttttcaatcagcatgcctcctgccatattattgaatccatatgacattcctaacgcctggataaaacctagaacaattgtaaaataccttgtgaattgtgctaattttcggcggccaacctctccttgctttgaccactcagtgaacttcggaacaacatccatctgcaagagctgaatgatgatcgaagcagtgatatacggcataatccccattgcaagaatggagaattggaaaagtgccccgcccccaaacgtgttgaggatcccgaaaacactcatttgatcctgtgcctggagaacttcggcgttcacattaggcacagggatgaaagcacctatacgaaagacgattaacattaaaagagtgaatataatcttattccgtatatctttcacgcgcataaaattggagattgtcttaaacaagttagatcacctcggctgtaccgccagcagcttcaatcgcttctttagcagaagcagagaatttattggcttttacagttaattttttttctaatttaccgttgccaagaatttttactcctgcttttaacttgcttattgcaccagtctctagaagaagttcaggagttacttccgttccttcgtcaaaactgtttaatctgtctaagttgattaccgcgtaatctttacggttgatgtttgtaaaaccacgttttggaagacgttggaataaaggcatctgaccaccttcgaaaccagggcgtacaccgccgccagaacgagcgttttgacctttatgacctttaccagaagttttaccgttacctgatccaataccacgaccaacacggttgcgttctttacgtgaaccttctgaaggcttcaattcatgaagtttcatttgggcacctccttatcgattaaaaatgttttattgttctttaacagaaactaaatgagacaccttgttaatcatgccgcggatcgctgcattgtcttcatgtacgactgtttggtttgttttctttagaccaagagtacgaacagtgacacactgatcttctgggcgaccgattacactgcgtttgagggtaatttctaatttatttgccattattgttccctccttatcctaacaggtcttctacagattttccacgaagcttcgcaacgtcttcagcacgtttaagttcacttaaaccctgaagtgttgcgcggatcatgttgatcggtgtattagaacctagagatttagaaaggatatcagctagaccagcaagctcaagaaccgcacgcactgggcctccagcgataactcctgtaccttctgaagcaggcttcaatagaacgtttcctgcaccgaatcgaccgatgatttcatgtggaattgtagttccaaccattggtacttcaattaaattctttttcgcatcttcaacagctttgcggatcgcttctggtacttcttgtgctttaccagtaccgaaacctacatgaccgtttttgtcaccgacaacaactaaagctgcaaaacggaaacgacgtccacctttaacaactttcgctacgcggttaaccgtaactaagcgttcttctaactctaatttgctttggtcaatacgactcattcggatgtgtccctccttcttttattaaaatttaagtccagcctcacgagcagcttcagctagagcttttacacgtccatgatataagtatcctccgcggtcaaataccacgttagaaattcctttttcaacagcacgttttgcaacaagttcgccaactttagtagcagctgcagcgtcagaactattctcgatctttaactctttatcaagagtagaagcacttacaagtgttacaccgttaacatcatcaattacttgagcgtagatgttcttgttagaacggaaaacgttaaggcgaggtctttcagcagtacctgaaagtttcgcacgaacacgagcgtgtcttttaagacgagtagcgtttttgctagttttcgtaatcatccgagtcactcctttcttcacattaagcgatcttacttaccagtttttccttctttacggcgaacgaattcaccttcgtaacgaattcctttacctttgtaaggctctggagaacggacagcgcggatgttagaagctagagctcccacacgctctttatcgatacctttaacgactactttcgtttgagatggaacttcgacttcaactccagcctcaggaacgatttcaactggatgagagtatccaacgttaagaacaagtttgtttccagatttagctgcacggtaaccgacaccgataagttctaaacctctttcgaaacctttagatacaccttcaaccatgtttgcaattaagctacgtgttgtaccatgtaaagcacggtgttctttatgatcagacggacggcttacagttaagacgctgtcctcaattttaatttccatatcagggtgaaatgtacgagttagttcaccttttggtccctttactgtcactgtgttatcgttgtttgtcacagtaactcctgaagggatctcgattagttttttacctatacgagacataccaagcacctccattcatcttaaactttttttaccatacgtaagcaagtacttctccaccagcttgtttagcacgggcttctttgtccgataaaacaccttgtgatgtagaaataattgcgattccaagtccgttaagtacacgtggtacttcatttgatttcgcatatacacgtaaaccaggtttactgattctttttagaccagtgataacacgttcgttgttttggccatatttaaggaacatacggataattccttgtttgctgtcttcaacatattcaacgtcacggataaaaccttcacgctttaagatttcagcaatttctcttttgatttttgaagccggtacttctagcttctcatgacgtaccatgttcgcattgcgaatacgagtcagcaaatctgcaatcggatctgtcataaccattatttaataacctccttcccatttatggggattaccagctggcttttttaacgccaggaatttgtcctttatatgcaagttcgcggaaacaaatacggcaaagtttaaacttgcgaattactgaatgtggacgtccacaacgttcgcagcgcgtatactcttgaactttaaacttttgtttgcgttgttgtttcgcaatcatagactttttagccacgatttcgcctccctttcattgattatttctggaacggcatacctacttgagttaataactcacgtgcttcttcgtccgtattggcagtcgtaacgataacgatatccataccgcggacttttgttactttatcgtaatcaatttctgggaagattaactgttctttaataccaagcgtgtagtttccacgaccgtcgaaagatttcttagaaatcccgcggaagtcacgtacacgtggtaaagatacagaaataagtttatcaaggaaatcgtacatgcgctctccgcgaagtgttactttcgcaccgattggcattccttcacgtagacggaatccagcaatagacttcttcgcacgagtaacgacaggtttttgaccagcgataaacgttaattcttcaacagcagtatcgattgctttagcgttttgaacggcgtcaccaacacccatgttgatcacgattttttcgatttttggcacttgcattactgatttgtattcaaacttagaaactaatgcaggtgtaatttcttttacatacttttctttaaggcggttcatgagaaagacctcccttccttatttactatttatctagaacttgcccagattttttcgctacacggactttctttccgtcctcaactttatacccaacacgtgtcacttcacccgttttaggatcaagcggcataacgtttgatacgtggatcggcgcttcttgttcagaaattccgccctgagggttagcttgggttggtttagagtgttttttcacaaggttaataccttctactaaaacacggtcattcttagggaaagcagcaaggatgactccttgtttacctttatctttaccagagataaccactactttatcgccctttttaacatgcatttaatcgcacctccttgagtcgcggattgtattcattaaagtacttctggtgctagagaaacaattttcatatagttgttttcacgaagttcacgtgctactggtccgaagatacgagttccacgtgggctcttgtcgtcacggataatgacacatgcattttcatcaaagctgatgtaagatccatcgtttctgcgagctccgctctttgtacgaacgataactgctttcacaacttcaccttttttgacaacgcctcctggtgttgcttgtttaaccgtacaaacaatgacatcaccgatgttagccgtcttacgtccagagccaccaagaactttaatcgttagtacttcgcgtgcgccagagttgtcagctacttttaaacgagtctcctgttgaatcattaatgttacctcctttcggaaaaagaaatccgaactttattagataataacggcttcttcgacaacttcaactagacgaaagcgtttagtcgcagataaaggacgagtttccatcacctttacgatgtctccgatttttgcttggttgttttcatcatgtgcttttaactttttagagtatcttacacgtttgccataaagtgaatgctttttgtatgtttcaactacaacagtgatggttttatccattttgtcagaaacaacacgaccttgatacactttacgttggttacgttcgctcatgtttgcggggcctcccctctaattattatttattagcagcgatttctctttgacgaatcacagttttcatgcgtgcgattgatttacgcacttcacgaatgcgagcagtgttttcaagctgcccagtcgctaattggaaacgaagattgaaaagttcttctttaagagactttactttttgttcaatttcagcagtggtaaggtcacgaatttcattagctttcatttgattcaccaccaatttcttcacgttttacgaacttcgttttaattggcaatttgtgagatgcaagacgaagagcttcacgagcaacttcttcagacacaccagaaatttcaaataaaactttgcccggttttactacagctacccatccttctggagcacctttaccggaacccatgcggacttctagaggttttgctgtgtatggcttagaagggaaaattttaatccaaactttaccgccacgtttcatgtaacgagtcatagcaatacgagcagcttcgatttgacggtttgtgatccaagaagcttctagagcttggataccgtactcaccgaaatgtacttcagtaccaccttttgcacgaccacgcatttttccacgatgttctctgcgatacttcacgcgttttggcaataacatattattttcctccttccgcagtattcttcttagttggaaggacttctccacgatagatccatacttttacgccaagcttaccataagtagtgtcagcttcagcagtagcatagtcgatgtcagcacgaagtgtgtgcaacggaacagtaccttcactgtaatattcagaacgagcaatatctgcaccgccaagacgaccagaaaccattgttttgattccttgtgctccagcacgcattgtgcgttggattgtttgtttttgtgcacgacggaatgaaatacgattttcaagttgacgagcgatgttttcagcaactagctgagcatcaagatctgctcttttgatttcaaggatgttgatgtgtacacgtttgccagttaggctgttaagagctttacgaagtgcttcaacttcagatccgcctttaccaattaccatacctggtttagccgtgtggattgtgatatttacgcggtttgcagcacgttcgatttctactttagaaacagacgcgtcagacaaacgcttgctgatgaattcacggattttcaagtcttcatgtaagaagtcagcgtaatcttttcctgcgaaccatttagattcccaatcacgaatgacgccaatacgaagacctactggatttaccttttgacccacggattatccctccttcttttctgatacaacgattgtaatgtggctagtacgtttgttaattgcgctcgcacgacccatagcacgtggacggaatctcttaagtgttggaccttcgtcaacgaatgcttgtgagatcactaggctgttagcgtccaactcgtagttgtgctcagcgtttgcgatagcagattttaatactttttcaataattggtgaagcagccttaggtgtaaggtttaagatagaaactgcttctcctacttgcttacctcggatcaggtccattactagacgtgctttacgaggagcaatacggactgttcttgcgacagctttagcttgcatttaaaagcctcctctcattagcgtcttgtttttttatcgtcactagcatgacctttgtaagtacggcttggtgcgaattcgcccaatttgtgacctaccatatcttcagaaatgaaaacaggtacatgtttgcgtccatcatagacagcgattgtgtgaccgatgaattgtgggaaaattgtagaacgacgagaccaagtttttacgacttgctttttgtcagtttcattcaatttctcgactttagccatcaaatgatcatcaacaaatggtcctttttttaagctgcgagccattgtggaacctcccttcgtgattgaactacggtcctaaatgaaccgtagacaaccccgttacttgtttttacgacgacgtacaatgaatttatcagacttgttggttttcttacgagtcttgaatccaagagtcggtttgccccatggagacattggtgatttacgtccgattggagcgcgtccttcaccaccaccgtgtgggtgatcgttagggttcattacagaaccacgaactgttgggcgtacgcctttccagcgtgaacgtccagctttaccgatgttaattaattcgtgttgctcgtttccaacttgaccgatagtcgcacggcaagcagaaagaatcatacgaacttctcctgagttcaaacgtacaagaacgtatttaccttctttaccaagaacttgagcagaagtaccagcagaacgaactaattgtccacctttacctggttttaattcaatgttatgcacaactgtaccaactgggatgttgataagtggaagagcgttacctggtttgatgtcagattctggtccagaagtaacttcagtaccaacttggattcctttcggagcaagaatgtaacgtttctcaccatctgcatagtttacaagagcgatgttcgctgaacggtttggatcatactcgattgtagcaacgcgtccaggtataccgtctttatcacgcttaaagtcgatgatacggtattgacgtttatgaccgccaccttgatgacgaacagtcattctaccttggttgttacgtccgccttttctgtgaagcggcgcaagcaacgatttttctggtttgtcagtcgtgatttcagcaaaatctgaagtagtcatgccacgacgaccattactggttggtttatactttttaatcgccattttgaatttccctccttctttttaagatttacgcttcaaaaatttcgatttctttgctgtcagcagttaatttcacgatcgcttttctgcgacggctagtcataccagtgtagcgtccaacgcgtttagattttcctttgtagttttgaacgttgactttctcaactttcactccaaagatttcttcaacagcatctttcacttctgttttgttagctctgacatcaacttcgaacgtgtacttcttctctgtcattagatcagcagaacgttcagtaatgatagggcgctttagaacatcacgaggatctttcattatgcaagtccctcctctactttttcaaccgctgctttagtgatcagaagtttctcgtggttgacaacgtcaagaacgttgataccgttagcttcaacaactgttactccagggatgttacgagcagataaagcaactgtttcgtttgcatccgcagtgacgatcaacgctttcttctcgacagataatcccttaaggatgcctgcgaattctttcgttttcactgcatcaagagtcagatcttcaagaacgatgatgttgttgtcgattactttagaagacaatactgacttgatagccaagcggcgaacttttttaggtaatttataagaatagctgcgtggtgttggaccgaatacgataccgcctccgcgccattgtggtgaacggatagaaccttgacgagcacgaccagtacccttctgtctccaaggcttacgacctccgccacgtacttcagaacgagtttttactttgtgagttccttgacgtaaggaagctctttgcataagaatagcatcgaatactacgctttcgtttggctcaattccaaacacagaagcgtttaattcgatttcaccgttagtagaaccgttttggttaaataatgctacttttggcatgacttgtttcctcctttcctaagagagttatttagatttaactgcactctttacagttactagagattttttagctcctggtacatttcctttgatcaatagaagattgcgttctgcatcaactttaacgatctcaaggttttggacagtgatttgctctccgcccatacgacccggaagaagtttacctttgaatactcggtttggatcaacaggtcccattgaaccaggacgacggtgataacgtgaaccgtgagtcattggtccgcgtgattgtccgtggcgcttgatagccccttggaatcctttaccttttgatgttcctgttacatctacgatatctccatttgcgaaaatatcaactttgacttcctgaccaacttcatacgcatctaactccgcaccgcgtaattcttttacgaagcgcttaggagcagtttccgctttagcaacgtggcccttctctggtttgttagaaagcttttcacgtttgtcgtcaaaaccgatttggattgcttcatagccatccgtgtcagtagtcttcttttgaagaacaacgttagcagcagcctcaacaacagttacagggataagatcaccgttttctgcgaacacttgcgtcataccaatttttctacctaagattcctttggtcattagtcacacctcctataatatgtgttttctatttgaattaaagtttgatttcgatatctacaccagatggtaaatctaaacgcataagtgcatcaactgtttgtggagttggattcacgatgtcgattagacgtttgtgagtacgcatctcaaattgctcacgagaatctttgtacttatgcaccgcacgaaggattgtgtaaactgatttttcagttggaagcggaattggaccagatacactagcaccagaacgcttagccgtttcaacaatcttctcagcagattgatcaagaattctatgatcatatgcttttaaacgaatacgaattttttgttttgccattattttccctccttttcgcctacttacgttagacagttctccgtgagaaaaacctgatcaccttgccatggcaaagcggccgggtgtgtcagcaacctctcacttcatcgcagtcaaagaccaacatgcactattgtaccaaattggcctgcgtgttgcaataataaatcggataaatttatgatttgcacacttttcatattatacaggggttgaacctataaatcaagctttccctgaagatgatgtacagcagtcttttttatggtacgaataaattcttctggttcttctagatgcggggaatgtgcagattctttaaaggtgaaccattctttgattggtgctgttaatttctcaacatatggttttgatacagcagctggtgtaatcatgtcatattcaccaatgataaagtaacaaggtattaatatagtagaaactcggtattcaatgctctcattcatcaattcatcccatagcatgtcctgactaagcttctgtcctttcaggaaattccacttatctttgagctgatatgtcttactaaaaagaaacccgcgcagcatttgaatcagcggcctccacttgtgtgtgaaacctacgcttccgagctctttatatagagagaacagagcatgagctgatattcgtttccacggaggaggcgtcagtaatcgcaaacaccatgtaaacaaccgattacgatggtatttcttcaaaagaagctcgtacgacacaatatcctcttttaatacatctactacctgactaattccataataagcatgatataaatctgggcgtttatgtactgcttgtatggcgattaatgacccccatgaatatccggcgatgtacagttttgattgacctagatatgaaaggaccttctctgtgagttcaatcgtatcttcaataaattgctgaatggtcatggagctatcggggagatacttttgataggaaagtcccgcacctcgctgatcccaatgaactactgtaaaatcctgcttaagcccctcatgaaacgaatcaatataactgatttgagcggagccgggcccaccgtgtacaaataatagaacaggcttcgtttcacttgtgtgatcttctttgatcataatccattggtcaactccgccgattaaccatttcttcaaatatgtcttcgccattccagtgatcctctcggttccatttagattctatagcttatagtagccgttctgatctggaaaagcaaaaaaagagacccttttgcaaggagtctcttttatatgttttattacttaatgatagttgaaacgacgccagaacctacagtacgtccaccctcacggatagagaaacgagttccttcttcgatagcgatagtagagataagttcaacttccatctcagtgttatcgccaggcattaccatttcagtaccttctggaagatgtacgataccagttacgtcagttgtacggaagtagaactgcggacggtagttagcgaagaatggagtatgacgtccaccctcttctttagaaagtacataaacttcagctttgaaacggctatgtggagtgattgtacctggtttagcaagtacttgaccacgttggatatcttcacgagatacaccacgaagtaatgcaccgatgttgtcaccagcttcagcatagtcaagaagcttacggaacatttcaacacctgtaacagttgttttaccattgtcttcttgaagaccgatgatttcaacttcgtcaccgactttaacttgtccacgctcaacacgaccagtagcaactgttccacgaccagtgattgagaatacgtcctcaactggcatcatgaatggcttgtcagtgtcacgctctggagttgggatgtactcatcaaccgcgtccataagttcaaagatttttgcttcgtaatcagcatctccttcaagagctttaagagcagaacctttgataactggaacatcgtcaccagggaagtcatagtcagaaagaaggtcacgaacttccatttcaacaagttcaagtaactcttcatcgtcaaccatgtcacatttgttaaggaatactacgatgtatggtacacctacgttacgagaaagtaggatgtgctcacgtgtttgtggcatcggaccatcagcagcagatactactaagatcgcgccgtccatttgagcagcaccagtgatcatgtttttaacgtagtcagcgtgtcctgggcagtctacgtgtgcatagtgacgagtgtctgtttcatactcgacgtgtgaagttgagattgtgattccacgctcgcgctcttctggagcaccatcgatttggtcatatcccatagctgatcctttaccagacttcttatgaagaactgttgagatagcagcagttagagttgttttaccatggtcaacgtgtccaattgtaccaatgttagcatgcgatttggaacggtcgaatttttctttagccattctaaaaatcctccttaaaggttcattgtatttggtatagagtgatagaaagtgaagagttacctctcactttctgatcttcaatagtagttatactttagtttaaaggcaaaatcaattattcacctttattttttttgatgatttcttcactaatgctcttaggcacttcttcgtagtgatccatgtgcatagtgaaagtaccgcgtccttgtgtgttagaacggagtgaagttgcatatccgaacatttcagaaagtggaaccattgcgcgaacaacttgagcgttaccgcgagcttccataccttctacacgtccacgacgagatgtgatatcacccatgatgtctcccatgtattcttcagggataacgacttccactttcatcattggctcaagtagaactgggttacatttgctaacagcatttttcaatgccatagatgcagcaattttaaacgccatttcgttcgagtcaacatcgtggtaagatccatcaaataatttagctttgatgtcgattaatgggaatccagctaatacaccattttcaagtgaatcttcaagacctgcttgaatagctggaatgtattcacgaggaacaaccccaccgacgattgcattttggaattcgaagcctgcgccttcttcgtttggttcgaattcgatccaaacgtgtccgaactgaccacgtccaccagactgacgtacgaatttaccttcaacttttgcaccagaacggaatgtttcacggtacgcaacttgaggagctcctacgttagcttcaaccttgaactcacgcttcatacggtcaacaatgatatcaaggtgaagctcacccataccagagatgatcgtttgaccagtttcagggtttgtttgtgtacggaatgtaggatcctcttcagctagtttagctaaagcgatacccattttatcttggtcagcctttgatttaggctcgattgctacatcgataactggctctgggaattccatagactcaaggataacagtatctttctcgtcacaaagagtgtcaccagtagatgtatctttaagaccaacagctgctgcgatatcccctgcatatacagtagagatttcttcacggctgtttgcgtgcatttgaaggatacgtccaacacgctcacgcttgttcttagaagagttcttcacgtatgaacctgaagcaagtgttccagagtatacgcggaagaaagttagtttcccaacataagggtcagtcataactttaaatgcaagagctgcgaatggtgcgtcatcagtagactcacgaacaacctcttcattagaatctggcaggatacctttgattgcagcaacatcagttggtgcaggaaggtaatcaagcacagcatcaagtacaagctgaacacctttgtttttgaaagcagatccaacaagaactgggtagaattcaacattcaacgttcctttacggattgcagctttcaattcaggaattgtaatttcttcaccctcaaggtatttttccataagctcttcatcaagctcagcgacagcttcaataaggctgttgcgaagctcttcagctttgtctttatactcagcaggaatttcttgtgcatcagagcgagttccaaggtcatcttcgtagaagtatgctacgttatctacaaggtcgatgattccttcgaattgatcttcagcgccgatcggcaattgaattgcatgagcgttcgcttgaagacgatctcttaatgtgcttacagagtaaaggaagtccgcaccggttttatccattttgttaacgaatacgatacgaggtactccgtaagttgttgcttggcgccaaactgtttcagtttgtggctctacacctgattgtgcatcaagaactgctaccgcaccatcaagtacacgtaaagaacgttcaacttcaacagtgaagtctacgtgtcctggtgtatcgatgatgtttacacggtaacctttccattgtgctgtagtagcagcagaagtgattgtaataccacgttcttgctcctgctccatccagtccatttgggaagctccttcgtgagtttcaccaattttatggatacgaccagtgtagtataagatacgctcagtcgttgtcgttttaccggcatcgatgtgagccatgataccaatattacgagttttgtctaaggagaactctcttgccattgggtaatttctccttccttattagggaatagtttttttagtttggtataaatcctaccagcggtagtgagcgaatgctttgttcgcttctgccattttgtgtgtatcttcacgtttcttaacagcagcaccagtgttgttagctgcgtcaaggatttcgttagcaagacgctcttccatcgttttttctccacgaagacgagcgtagtttactaaccagcgaagacctaaagtagtacgacggtctgggcgaacttctacaggaacttggtagttagctccacctacacgacgtgctttaacttcaagaactggcatgatgtttttcaaggcttgttcgaaaacctccatcgcttcattaccagtacgttctttgatgatatcaaatgacttgtagagaattgtttgtgactttcctcttttaccgtcgatcatcattttgttgatcaaacgagatacaagtttagaattgtaaattggatctggcaatacgtctctttttgctacaggacctttacgtggcatctgatagcctcccttctcatttaaaaggatttctatctgtctctcatctcaatatcattgtcagttgcctgactccactgatctgatatcaacttctaaaaacccttatgtttgtttgtattatttgctttgtttagggcgttttgttccgtatttagaacgtccttgcatacgaccgtcaactccggcagtatcaagcgcaccacgaacgatgtggtaacgtacacccggtaagtcttttacacgtccgccacggataagtactacactgtgctcttgtagattatgtccgataccaggaatgtaagctgttacctcaatcaggttagacaaacgtacacgagcatatttacgtagtgctgagtttggttttttcggtgtcattgtaccgacacgagtacaaaccccgcgcttctgtggagatgttacgttagtgtgctcttttttgaaactgttgtatcctttgttaagtgcaggagactttgagttttcaactttactcacgcgtcctttgcgtattagctgattaattgtaggcatgttgttattcctcccttcgttgctttttttataacccacatacccaggtggttcattaaaaggcaaaaaacaatgcttttgcatttacacatgcaaaaacaaaacaagtacgctataacataatggcaacagctgctgccccaacttcaattccgcaggctttgccgagctttttcatggaatctaccactagaatgtctacacccttctcttgcgctagttttgttacactagctgttaaagcaggatcagcatctttcgctacgacgatttcctttactgaatctcgtttcagagcttttactgtttgcttcgtaccaataataatggattgggcctgtgatactttatcataagacatcgaatatcctccaaagtaacaggttttattttgagcaccttggttatattatcatcatggcagaaggatgtcaatatcatatgacagattatcttgacatccttcaccattttttgatgattttataggaatctcacgagaaagattactctacaggaaccatatcgtcagacggctgcacttgtgaaaccggcttaactttacggtaatttggcattcctgttccagctggaacaagtttaccgatgataacattctctttcaagccaagcagttcatcacgttttcctttgatcgccgcatctgttaggacacgagtcgtttcttggaaggatgctgcagacaagaatgagtctgtttcaagcgatgcttttgtaataccaagaagaactgggcggcctgttgcagggcgcttgccttcgaatagtacttttttgttcgcatcagtgaattgatgtacatcaagaagtgtgcctggtaatacatctgtatcccctgcatcagcgacacgcactttacgaagcatttggcgaaccattacctcaacgtgcttatctccgatttctaccccttgcatacggtatactttttgtacttcatgaagcagatattcttgaacagctgtcatgtcagtcactttaagaagttctttcggatcgatcgaaccttctgtcagtacttgaccacgagtgactttatcaccttcaacaactttcagacgtgcattgtaaggagctgtgtaagaacgagtttcaacgtcgccttgaaccacaatttcctgctgcttgtcacgaacatcgttaatttcagcaacaacaccatcaatttcagaaatggtcgcttgccctttcggattacgcgcttcaaatagctcttggatacgaggtaaaccttgtgtgatatcgtctcctgctaccccaccggtgtggaacgtacgcattgtaagctgtgttcctggctcaccgattgattgagcagcgatgattccaactgcttcaccgacttcaacgtcagtaccagttgcaaggttacggccgtagcatcgtttacatacaccatgaggcgtgttacatgtaaatgcagaacggatccatacttcctcaattcctgcttcaactacttcaagtgctttatcttcatcaattagttcgttttcgccaacaatgacttcgcccgtttcaggatgaacaattggttttcttgcaaaacgtccaattagacgttcttcaagtttctcaataatttcatttccttctctaatggacttcgccaagataccacggtctgtaccgcaatctgtttcacggatgataacatcctgtgcaacgtcgacgagacgacgcgtgaggtaacctgagtcagctgttttaagggctgtatcggcaagacctttacgcgctccgtgagtcgaaataaagtattccaatacggttaaaccttcacggaaactagatttgatcggaagttcgataatacgtccagccgggttggccatcagaccacgcataccagccagctgagtgaagttagatgcgttaccacgcgctccagagtcactcatcatgtagattgggttgacttcatcaagggacttcatcagtttaccttggatgacatctttagaagaactccagatcgaaatgactctctcgtaacgctcttcttcagtaatcaaaccacgtctgaattgcttcatgacgttatctacttttgcttgcgcttcttcgaggatcttctgtttatcatctaatacgacgatatcagacaccccaaccgtaatacccgctttagtagagtatttgaaaccaagatttttcatgcggtcaagcattttagatgtctcagtgatatggaatctcttaaagatttccgcaatgattttacctaaaataccttttttgaacggcgcattgatttcttgtttctcgatcgccactttgacatcttcacctttttcaaggaagaagcggtcaggcgttttttcttcaatattgctctttgtcggctcattcatgtaagggaatgattccggtaagatttcgttaaagatcagttttccaactgttgtaatcaacaatttagaacgctgttcatcagtgaatgtcacattcttcaacgagttagctgcaacagctacacgtgtatgaagatgcacatacccattttgataagctagaagggcttcgttcgtatctttgaagaccataccttctccgatagcacctttacgctcaagtgtaaggtagtagttaccaagcaccatatcctgagatggcgtaacaacaggttttccatctttcgggttcaaaatgttttgagcagcaagcattaagatacgagcttcagcttgagcctcagcagataatggtacgtgaaccgccatttggtcaccgtcaaagtcagcgttgtaggctgtacatacaagtggatgcagacgaattgcgcgtccttccacaagtgtaggttcaaacgcttgaataccaagtctgtgaagagtcggtgcacggtttagtaagactgggtgctcgcgaatcactgattctaaaacatcccatacttccggctgcacgcgctcaattttacgcttcgcactcttgatgttgtgagctaaacctttttcaacaagctccttcatcacgaatggtttgaataattcaagagccatttctttcggaagtccacactgatacattttcaaatgtggtcctacgacaataacggaacgtccagaatagtcaacacgtttaccaagcaagttttggcggaaacgtccttgtttccctttcaacatatgagaaagagatttcaatggtctgtttcctggtcctgttactggtcggcctctacgtccattatcaatcaaggcatcgacagcttcttgaagcatacgcttctcgttctgaacgatgatgcttggcgcgccaagatctaataaacgtttcagacgattgttacggttgatgacacgacgataaaggtcgtttaagtcagaagtagcaaaacgtccaccatcaagctgaaccattggacgtaattctggcggaataaccggaagtacatcaagaatcatccatgatggtttgtttcctgagttacggaaggcttctagcacttcaaggcgtttaatcgcacgtgtacgacgctgtccttgagcagttttcagctcttctttcagtgtatctacttctttgacaagatcgatatcttgaagcagtttattgattgcttctgcacccatagctgctgagaatgtattaccgtatttatctaaataagcacggaattccttctcagaaagaagttgtttcttctcaagcggtgtgttgcccggatctgtcacaacgtaagaagcgaagtaaatcacttcttctaacgcacgtggtgacatatcaagaacaagacccatacggcttgggatacctttgaaataccaaatgtgggaaactggggcagccagttcaatatgccccattctctcacgacggacttttgcccgtgttacttctacaccacaacggtcacacacaacacccttataacgaacgcgtttatactttccacaatgacattcccagtctttttgcggtccgaagatacgttcacaaaagagaccatccttttcaggtttcagtgtacgatagttaatcgtttcaggctttttcacttcaccaaaagaccaagaacggattttatcaggtgatgcgagaccgatgttcatatactcaaaattgttcacatctagcaaggggcctacctcccttttaatcttcgggttataccctagtcacttgctctaatcgtttctgctattcttttgtgactgcgtcacgttcaagatcgacaggtgcgaggtctgcagcatcttcgtcattagataacgctaatccgtctgctttcttcgtttcctcatcgtcttctaaatctctcatttctatctcttcttcatcgccagataggattttgacatccatacctaaactttgaagttctttgattaacactttgaatgattcagggacacctggttcagggacgttatcccctttgacgatggcttcgtatgttttcacacgacccacaacgtcatccgatttaactgttaagatctcttgaagtgtgtatgctgcaccgtaagcttcaagtgcccatacttccatctctccgaaacgctgaccaccaaactgtgctttaccgccaagtggctgctgcgtaacaagtgagtatggaccagttgaacgtgcgtgaagtttatcgtcaaccatgtgagccagtttgatcatgtacatgattccgactgatacacggttatcgaatggttcaccagttcgaccgtcataaaggactgttttcgcatcacgggacatacctgcttcttcaagcgtttcccaaacatcttcctcacgcgcaccatcaaatactggtgacgcaatgtggatgccaaggtaacgtgcagccatacccatatgaagctcaagtacctgaccgatgttcatacgagatggtacccctagagggtttaacatgatatcaatcggtgttccatctggaagatacggcatatcttcttctggaaggattttagagataacccctttgttaccatgtcgtccggccattttgtcaccttcagaaatcttacgcttctgaacgatgtatacgcggactaactggttaacacccggaggtaattcatctccatcttcacggttaaagactttgacgtcgtggataattccgccgccgccgtgtggaacacgtagagacgtatcacgtacttcacgagccttttcaccgaagattgcatgtaatagacgttcttcagctgttagttcggttacacctttaggcgttactttccctacaagaaggtctccgtcttttacttctgcaccgatacggatgattccacgctcgtcaaggttgcgtaaagcatcttccccaacgtttggaatatcacgagtgatttcttccggtccaagctttgtatcacgagcttctgattcatattcttcaatatgaatcgacgtgtagacgtcatcttttacaaggcgctcactcatgatgatcgcatcctcgtagttataaccgtcccaagtcatgaagccgaccatgacgttacgtcctagagccaattcacctttttccattgaaggaccgtctgcaaggatttctccttttacgacttcatctccaacacttacgattggacgctggttgtagcaagtcccttggttagagcggacaaatttcagcaagctgtatttgtctaggtttcctttgacttgttgtccgtcgacatcttcatagcggcgaacccaaatattttttgcttcaacacgttctacaacacctgggtagcggcagatgacagcagcaccagagtctttacctgatacatactccatacctgtaccaacaatcggtgattccggctgcatcaaaggcacagcctgacgttgcatgttcgctcccattagagcacggttagagtcatcgttttctaagaatggaatacatgctgtcgctgcagaaacaacctgctttggcgaaacgtccatgtagtcaacgcggtttcgaggaacaacggtgttttcccctctgaaacgagcaatgatattatcatcgataaacgaaccatcatcagctagaagagcgttcgcttgtgctactacgtagttatcctcttcatcagcagttaagtagtcgattctcggtgtcactttacctgtttcaggatcaaccctgcggtaaggtgtttcaataaagccgaaacgattcacttttgcaaatgaagatagagagttgatcaaaccaatgtttggaccctctggtgtttcaatcggacacatacgaccatagtgagagtagtgaacgtcacgaacttccattcctgcacgctcacgtgtcaaaccaccaggcccaagcgctgacagacgacgtttgtgcgtcaattcagcaagcgggtttgtttgatccatgaactgagaaagctgagaactaccaaagaactctttgatagaagcgatcacaggacgaatattgattagttgctgaggtgtgatcgtgtttgtgtcttggatcgacattctttcacgaacaacacgctccattctgcttaaaccaatacggaattggttctgcagaagctcacctacagaacgcaggcgacggttaccaaggtgatcgatatcatctgtgtcacctacaccatgaagaaggttgaagaagtaactgatcgatgcaatgatgtcagaaggcgtgatgtttttcacagcttcctctacgtatgcattcccgatcacgttgatcacttgctcgccttcttgatcagacggtgcataaatcttaatagattgaagttctacttcatcttctactacgccaccatttggatatagctttctaaatccgatgccgttttctaagtatggaagaactttatcaagaactcttctgtctaaaatttgacctttttctgctagaatttcacctgtttcagggtcaactaacgtctcagccaatttttgattgaacagtctatttttaatatgaagctttttattaatcttgtagcgtccaacatttgccaggtcatatctcttcggatcgaagaagcgagagtctagcaggcttttcgcattttcaacagttggcggctctccaggacggagacgctcgtagatttcgagaagtgctttatccgcattctctgtattgtctttttccagcgtgttgcgtaagtattcattctcgccaatgaggtcaagaatctcttgatcagagctgaagccgagagcacgcaaaagaaccgtaaccggcaacttacgtgtgcgatcgatgcgtacatagactacatccttcgcatcagtttcgtattctaaccatgcgccacggtttggaatgacagtcgcagtaaaaccttttttaccgtttttgtctactttaccactgaaatatacacttggagaacgtactaactgagaaacgattacacgttccgcaccgttaatgataaaagtacctgtgtctgtcatgattgggaaatcacccatgaacacatcttggtcttttacttctccagtttctttgttaattaaacgaacttttactcttagtggagcagagtaagttacatcacgttcttttgattctgctacaggatacttaggatcccctaggctgtaatcaatgaattcaagagaaaggttaccagtaaaatcctcaattggggatatatcttgaaacatctctctaagaccctcatcaagaaaccactgataagaagaggtttgaatttcaatgagatttggtaattctaacacttcgcttatgcgtgcgtagcttctgcgctggcggtgtcgtccatactgaactagttgacctgtcaactgattcacccctcaaatcatgcgtattatatgtgtaaaaagtatttcagcctttcaaatgtcagtaaagaaatacttttacaagacaaaagaaaaaagggtttctaaaataagaaaaccacatccaaaaacaaataccgattttattagttttcccaagtatgcataatttatacaaaatagttgttttttaagcctatcaagcaaaatatacacattggcattttataatgttaacacagctaggaaactgcgtcaaacttttttagctttgataatatagtagcccttttttttcaatacaacttcgacttctccaaagagctgttctaatttctcaatcgcagatggtccgccctgctttttctgaataaccacccacaactcaccttccggcaataaatgatcagcacttttttcaaagatcgcatgtacaactttcttccctgcccgtattgggggattggtcagtatagaggcaaaagcagctgatgaatgaacattcgagaacaaatcactttgatagatgcggacattatcaatgcgattatgtttagcgttttcctttgaaagttcgactgctctttcgttcacatcaatcatatgaatggtgcggctcgtcatttcgtttgctaacgataagccaatcggtccataaccgcaaccgacatctaagacatcgccacccacgtcaggttcttcaaaagcttcaattaaaagcctcgaaccaaagtcgacttctttcttagaaaacactccactgtcacttgtaaaagtataggtacggtttctcaaggtgaagtcccatgtctgtttattgcttttcactgatggcttttccgtataatagtggtcactcatggtgaattggacctcctctggattcaatcgtttcaggagaatagaaaagaaaaagcccgccagtaaaagcgagctttcccaaaagattaggcgaagattacttaacttctacagaagcgccaacttcttcaagcttagctttaagttcttcagcttcttctttagcaataccttctttaagtggttttggagtgttgtcaacaagttctttagcttctttcaagccaagaccagtgatttcacgaaccactttgataactttgattttttgatctccagcaccagcaagtactagatcaaaatcagttttttcttcagcagcagcaccgccaccagcagctacagctacaggagcagcagcagttacgccaaattcttcttcgattgcttttactaagtcgtttaactcaagtacagttgcttctttaactgaagcaatgatttcttcgatatttaaagccatttgtaattcctccattttaagttttttacgtcaagtacgcattaagcaccttgttcttctttttgatctgcaactgctttagtagcaagagcaaggttacgaactggagcttgaagaacgctaagcaacatagatagtaagccttcgcgagacggaagttccgcaagagccttcacttcttctacagtcgctacgtttccttcgatgacaccagctttgatttctaaagcttcgtggcttttcgcaaattcgttgatgattttcgcaggtgcgataacatcttcgttactgaatgcgatagcgtttggacctgttaagaaatcgtttaaacccgttagttcaacttgttcaactgcacggcgagtcaaagtatttttgtaaactttgaattctacgccagcgtcacgaagctgtttacgaagttcagtcacttcagaaactgaaagaccgcggtaatctacaatgacagtagacatactatctttaaatttagaagtaatttcatcaacgacaactttttttgtatcgattgcattgctcatggttacacctcctgtacattgtttgtgtaacacttataccgatcaggccatcacgttcctaacgaacggttctccatataaaaagcctccattaagacatggaggctgtatatacaagcatacgttaacgtaagactgtgacatatacacctcggcgggttaattaagccataaggcccctgctgtctacggtataaatggacatattctattttacaacattttgatattatcaaaatgattgtgataagtcaagatttattttgcagagaaagaagatggatccactttcacgccagggcccatagtagatgtaacagaaacgtttttcacgtatacacctttagccgctgcaggttttgctttaaggattgtgtcatagattgttgcaaagttctcaacaagcttttcgtcctcgaaagaaacctttccgattggcgcgtggatgttaccagctttatcaacgcggtattctactttaccagctttgatttcattgattgctttttctacttcgaatgtaacagttcctgttttagggtttggcataagaccttttggtccaagtacacgaccgatcttaccaacttcacccatcatgtcaggtgtcgcaacgattacatcgaattcaaaccagccttgttggattttagtgatgtaatcagaatctccaacgtagtctgctccagcagcttctgcttcttttgctttttcgcctttagcgaacacaagaacgcgttgagttttaccagttccgttaggaagtacaactgcaccgcggatttgttgatcgtttttacgagggtctacgcccaaacgaaaagcaacttctacagtcgcatcaaatttcgctgtatttgctttttttgtaagagaaacagcttcagctacatcatacgctttagtacgttcgatcagcttagcagcttctacatactttttaccttttttagccattataaaaatcctccttatgtggttttagcggaataacctcccacgaataagggttgcgaacttgtcaaaaccaaactcgcaacccaacaagacaataaattaatcttcgatgacaatacccatactgcgtgcagtaccttcaaccatgcgcatagctgattcaacgctagcagcgtttaagtcaggcatttttgtttccgcgatttcgcgtactttatcacgcttaacagttgccactttattacggttaggttcaccagaaccagactcaataccagctgcttttttaagtaaaactgcagcaggtggagttttagtaataaatgtaaatgaacggtcttcaaaaaccgaaatttcaacaggaatgataagaccagcttggtcagctgtacgagcattaaactccttacagaatcccatgatattaacaccggcttgacctagtgcaggtccaactggtggagctgggttagcttttccagcaggaatttgcaatttaacaactttaactacttttttagccacgagacacacctccttaaagtccgtgatgtggtaataggggaatccccctcccactcaacaacttcattctttatatgaatgacgaaataactagctagcgatcttgagcgaactcaagacgtacctttgctatattaccacttctatacactcatttcaagctcttttgaattacaatttatcgatctgcgtgaactcaagttccacgggtgtttctctaccaaacatattaacgaatactttgactttgcttttatcgtaatcaatctcttcaatagagcctgtgaagttagcaaatggtccgtcgatgaccttgactgtttctttcaattcaaagtcgatttctgttttgcgttcttcaaggcccattctcttcagaatggtttcagcttcgcctggcagcagcgctgtcggcttcgagcctgatccagctgatccaacgaatcctgtgacacctggtgtattacgaacaacataccaagagtcgtcagtcatcacgatttccactagaacatagccagggaatactttctttttgacaacttttttcttaccatttttaatatctgtttcttcttcttctggtacgacaacgcggaagatcttatcttgcatgcccattgattcaacacgcttttccaagttcgcttttactttgttttcatagccagagtacgtatgcacaacataccaattcttttccatttcgttcaggactattcagtccttccctccccacatttcgtaatgtctatttgacgaatctcgagtaccggtaaatattttcaagcaattgaaaaaacccgtaaaacgggttttttggcaagtcatattatgatctattatagcacgttcagcagaccattattcaagtattaatgaattaattcgattaattgtgagattcctatatcaagaaaagagaaaaagattgcaaagaatacgactgttaaaataacagtgattgtgtaacgaatcatttcgtttttctttggccagctgaccttcttcatttcttttccgacactttttaagaaactgataatacgcattgtaaaagacctccacagattaaagaacgcaaatcttacttcgtttctaaatgtgttttatgtgaattacaagtcttgcaatatttcttaacttctaatctttcagctgctgaagcatcacttttcattgtcgtataattgcggcttccgcagtctttacaggctagagtaatctttttcctcatatttacacctattttctcgacatcatttccttagtaccttatcacagtgtcgaaaaagctgtcaatataggtttgattagagactaatctcgcgaagctctaaatatttctctaattttctctttactctttggagtgcgttatcaattgatttcacatgacggtttaaatcttcagaaatctcttgataggatctgccatcaaggtaaagcacaagaacctttctttccagctcgcttagtagttcacccatcttcatttcgatatcatcaaattcttctttgctaatgattaaatcttctgggttaagcgctttagcaccggaaatgacgtccaacaatgttctgtctgattcttcatcatatattggcttatctaatgatacataggaatttaacgggatatgtttttggcgagtagctgttttaattgcggtgataatttggcgggtaatacataattctgcaaaagccttaaatgaagtaagcttgtcctctctgaaatcgcggatagacttataaagtccgatcatcccttcttggacaatatcctctcgatccgctccaatcaagaaataagatcttgcttttgcacgtacaaaattgcggtatttcgttattaagtaatctagcgcatcactatctccgacatgaaccctttcaatgacttgttcatcttccaactggcaaaattgctctctgatggatttatccttgctgttgtttagattcacttcgatccccccgaccgcacctagatagaaatattatacattaatggttgaaatatcgtcaagctattctagattcccacgccgccatttttcaaacgttttcaatacatcttctgacaattcaatcttggatgctggtttatcagaagtaatctttttgactctcgtttcaatctttcgttcgatcacttcaatctctcttaaaagctctcgagccgacttccgaagagctccttgtccaaagattgcccattgttctgtaaagtctgaggtcgccacatgaatctgcgtccgaatattattcaaatcctgggcaagcttttcaatccgctcatcagctgtttcattctctctcgtaaagatgacctctacccggtgattgatccgctttttttcgattcctttgaccatatgggcatcgaatacgacaatgactcgataccctgtgtatgcttgatattctgctaaattttgaatcagtatgtctctggcttcttcaaagctgttttcctttaagtgctgcagccgcggccatgcacctatcatgttgtatccatcgactaagaggatgtccatctctattctcctaacggataacgttttcgatacacttcatacatcaatagactagcagcaactgacgcgtttaacgaagtgacctttccggccataggcagcttaatcagaaaatcacacttttctttgatcaatcggccaatccctttcccttcactgccaatcacgagagcaagcggcatcgtgccatcaaattgtctgtaatcctgtttggcagacgcatctgttcccgcgacccagattcctctttctttcatctcatcaagagctcttgaaagattggtaactttggcaacaggaatatgttcaattgctccagtggatgctttggcaacggttgtcgttaagccgaccgctctccttttcggaatgacaatcccatgtgcacctacagcatctgctgtacgcataatggaacctaaattatgagggtcttcaatttcatctaagataagaaaaaacggctgttcattccgctgttcagcgatttgatatagatcgtccaattctgcatattcatatgctgctacttgtgcaacgattccctggtgctgacctgttaccatttgatcaagctttttcctcggaacatactgaatggtgatattttgtttttttgcgagttcaatgacctgctgggcttgtccttttacagtgttttctgccatccagagcttgtataactcccgatctgacttcagtgtttcaatcactgcatttttcccaatcacataatcatgttgctgactcatttgtcttcctccctgacgttccgatttcaatcgcctgactaatcagctcttctaagcgttcgtcctgcttttcaataaataaataacccatgagcgcttcaaacgccgtactataacgatacgtttgaacgtctgtgtttttaggcactgtgcctgattttgcatttcttcctcttttcaacaccgcttcttctgcttcagtgaaaaagccttgctgctgaagcgtaaataaaatagctgcctgagatttagctgaaacaattttgcttgctcgtttgtgcagctcatttggttttgtcgcccccgtttggaggaggtgatgcctcacgtagacttcaaaaatggcatcacccatataagcaagcgcaagtccgttcaattgtttaccgtctttcagcttttcaaaattcaacatgacctattctcctcttttccagcgagtaccttgaggagtatcctccaatacaatattcatgctctttaactggtcacgaatttgatcagatagcgcaaaatcacgatttcttctagcctcattgcgtttttcaattaacgcttctacttcttcgtcaagcgtatgcttttcttctaatgagaagccaaggacagaggtgatttcttggaacaagccgataaatgccttgatcacttcctccgaagtatgatcattttccatataataattcgcctgtttcgcaagttcgaataaaacagagatcgcatttgccgtattgaagtcatcattcatttcagaaataaacgtcgctcgctgctcttcaaccttcgccagccattcagcattatcttctgtgatattcgtgctgctttcaaggcgatgatgtaaattagcatacgacgttttgagccggttaaacgcactctttgtactctctagtaagtccattgagtagttaattggatgacggtagtgaaccgacaacataaagaatcgaagtacgtcaggatcttgttctttcacaatgtcatgcacgagcacaaagttgcctagtgattttgacattttttcattctcaatattaatatatccgttatgcatccaatactttgcaaaaggtttgcctgtcaaagcctcagattgagcgatttcattttcatggtgagggaaggttaaatcctgtccgcctgcatgaatatcgatcgtatcacctaaatattttttaaccatggctgagcattcgatatgccagcctgggcgtccttcgccccacgggctatcccatgagatttcttggtcctttgcagccttccataaagcaaagtccagcgcatctcgtttcttctcacctacacgaatacgggcacctgtctttagttcatcaatcgactggtgagaaagctttccgtagccttcaaatgagcgtgtgctgtaatacacgtcaccatctgcttcataggcgtagcccttctcaatcaatgtcgcaataaatgcaatgatatcatccatattttccgtcactcgcgggtgaaggtcagcttttttgcagcctagtgcactgacgtcttcaaagtaggcttggataaaacggtcagcaatcgtcggaacatcttctccgagttcattggctgctttgatgagtttatcatccacatctgtaaaatttgagacaaagttcacatcatagccactgtattctaaatacttacgtacagtgtcataaacaatagcaggtcttgcattcccaatatggatgtagttataaacggttggtccgcacacatacatcttgacctttcctggttcaagcgggacgaattcttctttcttacgtgtcaatgtattataaatattgattgtcatgattgttcttcctttctgctcaatgaagccagctcaccttttagcttttccatttctcgttccaattctttgaaacgatcggaaattggatctggcaaatcttgatgattgagatcacgattaattttcttaccattttgaacgacgactcgcccaggtataccgacaacggtggaatggtctggtacgtcctttaacacgaccgaccccgctccaatcttggctccttttccgacagtaatggaaccgagcacttttgcacctgtcgcaatgagtgcatcgtctaaaatggtcgggtgccgctttcccttttctttccctgttccccctaatgtcacgccttggaaaacagtgacgttgtctccaatttcacatgtttccccaatcaccactcccataccgtggtcaatgaagaagcgcctgccgatggttgccgcagggtgaatttccacccctgtgaaaaaccggctgacctgagaaatgatccgagcaagaaagtacagcttccgcttataaaatgcatgcgcgatacgatgagcccaaatcgcatgaagccctgaataggttagcactacttcaatatagcttctagcagcaggatcttgatcaaacacagtatcaatgtcttctttcagcattttgaaaaacacatgcttccccccgttcttccccatcaatctctcttcggacttgctctcttttttggacaaataaaaaacgcctctgccatatgacagagacgttttgaaaacgcggttccactctgtttagaaagccctcatttcgcagccttctcaacttaatcccataacggagggtaccgcccttgcatactaacgtactcgtgttcctcaagggtcttgagggtgcatttccaacgtctgcccataagtctctttcagccggtggagactctttctgtgatgggcgaaaacattgtacttctccctcgcaacgatttccttatatttgtttaatgcggtttaataccgtttcttttcctagtagttcaatactttgcggaagttctgggccatgcgtttgtcctgtgacagccacacgaattggcatgaagagtttcttgcctttatgccctgtttctttttgtaccgctttaatagcagccttgatttcatcaggtgtgaaagattcaagtcgttcaagctgaccagcaaaagacgccatgacttctggtacttgctcctctgctagaacttccttcgcctcttgattatactcaatttgctccttaaagaacaactctgttaactcaacaatttctgctccatagctcaattgttcgtgatacagagcaatcagcttgcgcacccacgtgttttcttcatctgacagctgctcacttactttgcctgccttttgaagatgtggaagtgttaacgcaacaacctgatcaagatcaagtgctttcacgtattggttatttacccattttagtttatgcatatcgaatagagctggtgacttagaaagtcgatttacatcgaaaatgtcgatgaattgctcttttgtaaacagttcttcttcgcccactggagaccatccaagtagtgcaatgaagttgaacagggcttctggtaaatagcctaagtttttatattgctcgatgaattgaataatggattcatcacgcttgcttaatttcttgcggttctcgttcacaatcagcgtcatatgtccgaatagcggaacatcccagccgaatgcgttgaagatcatgatttgtttaggcgtattcgaaatgtgatcctctccgcggagaatgtgagtcattttcatcaaatgatcatctactgctacagcgaagttataagtcggcgtaccatctttcttcacaatgacaaagtcaccgatgccgtctgtctcaaatgaaatatcgcctttgaccatgtcgtcaaatttgatgatttctccttttggcactcggaagcggatgcttggctctcttccttcagcaattagcttgtcctcttcttcttttgataaatgactgcatttaccagaatatcgaggcatttcactgcgggcgatttgtgcttcacgctcttcctctagctcttcagccgtacaatagcacttatacgccaagtccttctctagcagctcatcataatactttttataaatatcattacgctctgattgtctgtaaggaccgtagccgccatctttatcaatgctctcatcccaatcaataccgagccattgcaggtggcgcagctggctttcttctccgccctctacattacgcttttggtccgtatcttcgattcgaataataaatttgccgccttgactgcgtgcgaacaaatagttgaaaagagccgttctagcattcccaatatgtaaatgaccagttggactcggtgcataacgaacacgcacttcatttcccatgagtttaacttcctttcatctgcatcatgttgtctgacaccaattttttataaacgtattttatcatcaaatcacattctcatcaaaatgagttttactttttctgaagaagcaccgttgcttgagaggcaattccttcgcctcttcctgtaaatccgagtttctccgtcgttgttgctttcacattcacctgtgtgacctctgcctcaagcgcttctgcaatcttctcacacatcggttgaatgtaaggtgccattttgggcttttgcgccataatggtgcaatcaatattcacaagtgtgtagcctttttcctttactagtgcccacacatgctgcagtaatttaaaagaatccgcatccttaaactcaggatctgtgtctgggaaatgtctgccgatatctccttcagcaatcgcacctaggcaggcatctgccactgtgtgaagcagtacatcagcgtctgaatgcccaagcagccccttttcataagggatggtaaccccgccgataatcaaaggtcttccctcagttaattgatgtacatcaaagccttgtcctattctcaacatgatctagtaccctctttccgcatccataattgccttggcaaccaataaatcatccggtgtcgtcagcttaatattggtgtaatctccttggacaatatacacgtcttcaccatgtaattgttccacaagactggcgtcgtctgttccaaggaaaccggtccgctctgcatattcatgcgcctcttttaaaatagaatgacgaaaagcttgtggggtctggactgcccacaagctctgacgttcaatggtttgttccactttgccttcttgaacgcgtttgattgtgtctttcactggtaccgctacaactgcggagcctttttcaatcgctgctttaacgagcaagtcaatctgtgtatgcttaataaaaggccttgctccatcatgaacaagcacgatgtctgcatctttcacagcctttaatccttcgtatacactttgctgacgttcttcgccgccggtaacaagtgaaacaggcgtttgaaaagcgtgtaccttgagtagcctttcaaagtcttgacgctcctcttcattgatcgctaggatcatgcgtttgcattgagcatgagcgtcaaacacctttagtgtatgaataatgaccggcattctttttagctcaataaaaagcttattgcggccggccttcattcgtttcccctgccccgcagccggaataactacttcataatacatgttcgttctccctttagagcgccttctccagaagttttggcttcgcaaaaatcattcttccagcagcagtctgcagcacacttgtgacgagcacatcgatgtcttttccaatgtaattgcgtccttcttcgaccacaatcatcgtaccgtcatctaagtaagcaacaccttggttatgctctttcccatctttaatgacctgtaccttcatttcttccccaggcagcactaccggtttcaccgcattggctagatcattgatgtttaacactgctactttttgaagttcgcatactttatttaaattaaaatcatttgtcacaacaacacctgaagttaatttagcgagcttcacaagcttgctatcaacctcttgaatgtcttcaaagtcaccttcgtaaatttcaactttgatatctaattctttttgaatacgatttaaaatatcaagacctcttcggcctctatttctctttaatacatcagaagagtctgcaatatgctgtaattcctctagcacaaattgaggaatgaccatgatgccttctaagaatccagtttgacaaatatctgcgattcttccatcaatgataacacttgtgtctaaaattttcagctttttatcttctatttcaggttcatcatcagctgctccttttttcttggtgacctttgcagatcgggagaacagccccatcatttcatccttcttcttaaagcctacctgaaatccaaggtatcctaaaaagaaagccaggaaaatcggaataatggtaccaaaaatatgatatgggatattgtttagcgggatcacgtttacaataagatatgctagaataagtccaaatactaatccgaaacttccagaaataagatcaggaagaggcgcctttaagagagaatcctcgatccatttcacccaattaaccacataacctgtgcaccatttgccgatgataaagaacacagcggctcctattagtgctgaagagtaagcatttgttatgaaaggtatgtcctttacatttaacagcagaaataactctggaatgataaaaatccctacaactgcaccaaaaatgataaaaaacgcctgaacgattctttttaacataccttcacctcctttatttttcatctgtcaatccaccctcacctgacattgatatatgtttaagtttcctatcataatcaatagaaaacaaaagcatcattaatatacccatattcatccatttttaaccgtatttaaagaaaatttctcttcttacagctgtcggtcgatataatgtttttcttgcagcctttttaatcctttttttatctttttcgctcttacttctccaattccttctacttcatccaaatcttgtacatctgcttccataattcgatctaacacaccgaacgcttcaaccacgttttcgacgattggcataggcagtctagggattttgtgaagcagtctgtaacctcttgtgtacacatattcgtcaatatttgtagaagctggatagccaagtaacttgtacagaatggaatcatctaaaagctcaaagctagacatatcttggagctgtttaagcagaacatatggatctttaatcttttctttcacgtaatctttaataaataaagccgcttcctgctccatatctgtaatcagttcattgacttgcagacgaatcaaatgtccttctgttccaagctctttaatatacatattgatttcatttttgattctaagcaccatttcgtaacgatgcaggacggataatacatcaccaaaggtcacaagctcttcaaattccagggcgcttaacgcagaaatggcatgatctaaaatggttttatatttctcaagtgtttgtatggcttgattggccttcgttaaaataaagccaatatctttcagcgtataacgacgattcccttggtataaggtaatgacgttcctccgttcagaaatcgcaatgattaaacagcctgtctgcttcgctacacgttcagcagtacggtgcctcatgcccgtttccgatgaatgaatggttgcatctggcatgagctgtgtattcgcatacaagatcttttgaccagaatcgcttaaaataatggctccatccatcttcgccaattcatataagtgtgctggggagaaggcagaattaatatgaaatcctccatcgacaacactttttaccttgtcgttataaccaacaacaataagcccgccagtattggccctcaggacgttttcgatcccagcccgaagaggtgtccctggtgccacaaactgtacaatatctaagagatcgagttctctcgctccttttttctctttttccatttctatgatccccctagtgaaattcgaagtgcctccgctacattttcaacaccgactaactcaatccctctcggctttttccatccatctatattcgcttgaggaataaacattcgcttaaatcctagtttcgcagcttcctgcacacgctgttcaattcttgatactcttctgacttctcccgtcagaccgacctctcctataaagcaatccgcttgatgcggcgctgcgtctttaaagcttgatgcaatactgaccgcaatggccaagtcaattgctggttcgtcaagcttcacaccgcctgcgacctttaaatacgcatcctggttttgcagcagcagtccaacacgtttttctaaaaccgccatgagcagtgacactcgattatgatcaagaccagtggccattctacgcggatttccgaagcttgttggtgaaattaacgcttgtatctcgacaagaacaggtcttgttccttccattgaggcaacaacacacgaaccagatacacctgccgaacgttcttctaagaaaatttcggatgggtttaatacttccgtgagcccttcctctctcatttcaaaaatccctagttcattcgttgaaccaaatcggtttttcactgcacgtaagatacgaaacgtatgatgacgctcaccttcaaaataaagaaccgtgtccaccatatgctctaaaagacgtggacctgcgatcgagccttctttggtcacgtgaccaacaataaaaattggaatcccatttgtcttggcaatcttcatcagctgcgctgtacattctctcacttgagatacagacccaggggctgacgtaatatcgctttgataaacagtttgaatcgaatccaccacgacaaaagcgggtttcatctcttgtatagcagacgttatatactccatatcggtttcagccaaaacatgtaaagaggtgctttttatgccgaggcggtccgctcttaacttcgtttgtttaatggactcctcaccggatatgtataatacattctgatttttgtctgagagctgtgctgatacttgtaataataatgtggacttgccgatcccaggatctccgccaataagaacaagagagcctttgacaattccacttcctaatactcggttaaattcttctaaattcgttttgattcggggttcatctgatgtttcaattgcagaaataggtgaaggtttttgaatggtttggacagaatgattaaaagcgcttcgacggtttaccggctctttacgaacgacctcttctgtcatactgttccacgtgccgcagcctggacatttccccatccatttggctgattcataaccgcacgattggcatataaattttgattttgtcttagccatagattgaagaatacaactccttatactggtcagaaaataagtaaagggaggcatacaccttactggtatgcctcacacttttttcttactatattagttcgtagcagccgtcgtttttacgacaatttctccatcttccacatctaatacgatttgttgacctttttcaatattaccctttagaagctcctcagaaagtcgatcctccacatgcttttgaatcgctcttcttaacggacgcgcaccgtactcaaggtctacaccttcgtcggcaatcttcgcttttgctgcttctgtcaattcaattgaaaggtcttgttcttttaatcgtttcgtcaattgatcagacatgagagacacgatctcttttaaatgtttcttttcaagtgaatggaagacaatgatttcatcaatacggttgatgaattctggtctaaacgcacgtttcaactcgcccatcactttgcccttcatatctttgtaattttgaccttcatcctgcacgttaaagccaacatatttatttcgcttcagttcactagctccaacgttggatgtcatgatcaaaatcgtatttctaaagtcaacggtacgccctttagaatccgtcagacgaccatcttctaatacttgcagtaagatgttgaatacatctggatgcgccttttcaatctcgtctaaaagcacaacagaataaggttttcttctcactttttcagtcagttgtccgccttcttcatagccaacatagcctggaggtgacccaacaagtctagatgtagaatgtttctccatgtattcagacatatcgatacggatcatcgcttcttcatcaccaaaaatagactctgcaagtgctcttgcaagctccgttttaccaacccctgttgggcctaagaagataaaggagccaattggacgttttggatcttttagaccagcacgcgcacgtctcacagcttttgctacagcgacaaccgcttcatcctgcccgattacacgagaatggagtaattgttccatattcagaagcttatctgtttctgtttgggcaatttttgaaacaggcactcccgtccagctagagacaaccattgcgatatcatccactgatacctctgaattctcctgaccttgcttttctttccaagatttctttgtgacttctactttttcacgtaaacgctgctctgtatcgcgaagagaagctgctttttcaaattcctgactttgaacagccgcatccttttccttgcgtacttcatccaatttttgctctagttcttttaggttaggcggtgttgtgaaagaacgtaagcggactttcgaacctgcctcatcaattaaatcaatcgccttatctggaaggaaacgatcagaaatataacggtcagacagcttcaccgccgcctcaatcgcttcatctgtgatggacacacggtgatgtgcctcataacgatctctaagacctcttaagatttgaatactttcatcaacggatggctgatctacttgaattggctggaaacgtcgttcaagcgcagcatccttttcaatatatttacggtactcatctaacgttgttgccccgatacattgaagctctccacgtgctaaggatggtttgagaatattagatgcgtcaatcgcaccttctgctccgccagcaccaatcagtgtatgaagctcatcaatgaagagaatgatatttcctgcctgacgaatttcgtccatgacttttttcaaacgatcctcaaattcaccacgatatttcgttcctgctacaacggttcccatatcaagcgtcatcactcgtttatcccgcagaatttcaggcacttcattatgaataatttgctgtgcaagaccttcagcgatggctgttttaccaacaccgggctcaccaatcagcacagggttgttttttgttcttctgcttaggacctcaatgacacgctgaatttctttgcttcgtccaatgacagggtccaagctgtcttctttcgcaatcgctgttaaatctcttgccaagctatctaatgttggtgtatttgcattgctgttagagccagcggcagatgcacctgtttcattgctgccaagcagctgcaggacttgctgacgtgctttatttaagctcactccgaggttatttaaaacgcgggcagctacaccctctccctcgcgaataagacctaatagaatatgttctgtccctacataggaatgacctagctttcttgcttcatccattgaaagctcagtgaccttcttcgctctaggcgtataatgaggaatagcttgagacacctcttgccctcttccaatcaagctttcgacttctttttggattttatctgaaacaaggcccagtgcttctaacgcttttgcggcaataccctcaccctcgcgtacaagaccaagtaaaatgtgttcagtaccaatgttcttatggcctaggcgaatggcttcttcttgtgcaagtgctaataccttttgagctctttcagtgaatcttccaaacatcatatcgtttcatcctcctgtccattcctatgcatttctaaacgcagcctttctctaataatcgctgctcgttttatatctcgttcatttggctccaaagctcctccagaatattgttgaagaaagccaggctgtgtcaaaatcatgagttcattcagtatattacttgaaagccccttaatgatacctaaatcaattccaaggcgcacatctgacaaacacttagctgtttcctttgattcaatcatccgacaattggacaaaatccccaaggaacggtacactctgtcctcaagttcaattttagatgtttgatataacgcttttcgtgcagatcgctcttgttcaatgagctgagcggtcacactatttaaatcatctacaatatcctcttctgattgaccaagtgtcatttgatttgaaatttgaaagatgttccctattgcttcgctgccttcaccataaattcctctgactacaagacctaattgattaatcgccggaataatccgattcatttgtcttgtgagggctaaagcgggtaaatgcatcatgaccgaagccctaatacctgtacctacattggttggacagcttgttaagtatcctcgcttttcagaaaacgcataatccacttgctcttcaatccagtcatctatctggttagccgcttttaatgcattggctagttggaagcctgggaataagcattggattcgaatatggtcttcttcattcagcatcacactgatttcctcattttcagaaagcaaacaaccgccaaatcttgattctgctaagtttgggctgatcaaatgcttttcaacaagtactctctttgctaaaggctgcgtttcattcattcgaattagaacaaagtttccaatgtccttcacttcctggctagcaaacttttgctcgaattgctggagaacagcttcagcctcttcctgagaaaactgagttgggaaacgaacatgctctaagtttcgtgctagcctgattcgactgcttagaacaatgtcactttctggtcctttttgtttcatccattgacttaaagcgtcttgaataaaatgctggagcgacatgttgttaatctccctccctctgctgagattgctcatgctctaatgcacgaatttgatctcgaacttccgctgctttttcgaactcttcttgttcaattaactgcttcagctcttgctgcatcaactcaagtttccggcgcacatgaagactgccggcaatccgtttagggacttttccattatggactgtatttccactatggactttccgtaaaacagggttcaaatactgatcaaatgaacgatagcattctgcacagccaaaacggcctgtttttctgaattgttgaaaggttaagccacacttaggacattgatccacttctctcgcttcttgaaaaatagatgatcccttattcgcacttgtggtaaagctaggatcaatattcaataaacccgataataagttgtgaatcgagaaaccttggttcccactcatagcatatgaatcactgttttcttttgcacattgttcacatatgtgcatttcttgtttttctccatttataactttcgtaaagtgaaaagtggctggtctctcattgcattcttgacaaatcaatcttttcacccgctttactttaatttcaaagcatttaacatcgctttcatcatccgagcccgcaattcatctcgttcaggtaaatcaatgtgcaaaacagaacggtccatgacactgatcatcatctttgcttctctttcagataaaatgttattttcgacaagacgcatgatgatatgatcagaggcagcctgtgataaacgatgatatatttgggaaataatattgttcaataagtcgacttcatcattcattttgactttaatgatgcggatatagccaccgccgccacgcttactttcaacgatgtagcctctctcgctcgtaaagcgtgtattgataacatagttaatttgtgaaggtacgcattgaaacttatctgcaatttcattgcgcttaatttctaatatttctcgaccattctgatccaagacttctttcaagtactgctcgatgatatcagaaatattttgtgccactccgcctcctcctccattgactttgactatatttgactttaatcttactataaattttttcggtcgatttttcaagataatcgctcaactaagaatattatttccacatttatatggtgtcaaacctcctaaggatcagttccattaggaactggtcttttttgttttttaagaaaaggaacaaacacccgatctgacatggatacatatactaaactaccatctaaaacattcttaattttgtatacaattgaaagcgctagggcatactgaagctataagtggaggtgtcacaatggacaaaaaagagcgagaagcgatttgtttgatttgtgaagagaacaagacaaagggaatttatttatatcatcagtttttgtgccgagactgtgagcgaaagttaatttctacatcgacctcggatcctagctattcagattatgtgagaaagctcaaaaatcttcatacgccgcctttgtattcatagaccactagatggtctttttttatgagctatgaaggattgggcttgttttttggaacttagtttggacatcatccgtaattcataataagataaacagagagcctgattattcataggagtcgataaacatgaaatcaatcttttatacatttatatgggccatcctctctacttttttttcgcttgtgattttaaccgtcagtataggggttttccatcatcatgctggattatcgatactgtatgcgatgattgggtggggtgtgatgtttgtagggagcagatggactgctttccaattgtttttaaagaaacacggactgtctcgtagtgattatgtatatatcaaacagcatttaaaagaagcagggcaaaagcttgtgcgtttaaaaaaagctttatttgctgtgaaaaacgtacaaacaatcaaacataattatgaagtttttcggcttgcacgacgaatctatacaataacaaaaaaagagcctaatcgattttatgatgcacagcgtttttattttgaaagcttggattctgtcgttgaactaactgagaaatatgcactcttatataatcaacctaatcgtagtcatgagctggaaatgacattgagccaaacccgagtgacattgacagagctgcaaaagcaattgacgaatgatttgcagcaagtgttaggaagagatatagaagctcttcatattgagcttgaagtagctgataaaatgatgaagaaatagatgaaaggagtcaacactcgatgaaaccggaagatcacgccataacaccgcctacctccaatacagatcttcagtttcgggtgtttgataccttatctgatgaagaaaaaaaagaagccgtgcagcgagctcagcagatccctgacaatccgcaaaagctccttttctatggtacacgtgtgcaggaacgactattggaacaatcacaacagatgatgaaatatgttgagaaaaaagatatcgatcaaataggagatgtgctggaggcctttttgcagcagttgcatgtagtggagcctgaggatttagtgccaaagaaacagagcatttttttgaaatggtttcaacgagataagcgatctactcaggagatcatatcacgttttcaacatgcaaaatcacagatcgagagattgtcagcaaggcttcgttatgcaagaggcgtattaatctcggaccatatgttattagagcgtttatttgaagaaaatcaaacttattttcaagagatgacgatgcaggttgccgcggttgaagcgaaaatgtcaacgatagagcagcagtctctttcagaaacgcaactttctgttgaacggacaatagaggagcaattgatgagtcaagaagtcaatgaagaagagtatgtggagagactaaaggaacgaaagtatgatttgctgttaagccggcaaattgcattgcaatgtaatgctcaaattcggatgatccagcatacgaatcatacattggccaatcacattcaatcaactgtttcagcatctattcctctatggatcaaccaaatgtcgattgcattaacgcatattcagcagcgggccaattcagctcttgagaaccgaatcgaaaaaacatatgaaaatgtatcgaaacagcaggggcagattcttgaagaggcatctttagctcctatagatacgttgaaaaaggttcaacgtcaattagctgaaacattacaggaaacgttacaggtgaaagaacatggaagccaagagcgggctcaattgaaaagcagtatgtatgaggcagagcagcagttggcgaatccaataaaggaatgagaaaccatctttcggttcacttgtttgaacgttataatagaattaagatatcgttaaagtgaaaagggtcgatttgtttgagaacacctttatatacagcattagcacagcatgcggaaaagaaaccttattcttttcacgttccaggacatcacaatggagatgtcttttttgatgaggcacggtctcactatgcttccatccttcaactggatgtgacggagcttgaaggtcttgatgatcttcatcatccgactggggtcatccaagaggcagaacatttattgactaagctatatggttcagatcaaagcttcttccttgtgaatggcacaacagtcggaaatttggcgatggtgatgacagcatgccgcacgggagacgagatttttgtccagcgtaattgccataagtctgtcttccatgcgatcgagctggcaggggcaacgcctattttgatagacgctgagatagacgcacacttgcacgttccaacacatgtgacggatgatacagtgagaaaagccatagcaagacatcctcattgccgggtaatcgttttgacttatccgaattactacggacatgcagctgatttatcaaagctaattcacatgtgtcatgaagcaggtatggttgttttggttgatgaggcacatggtgcgcattttgtattaggcggcggctttcctccatcggctctttcctatggagcggacgtggtggtacaatcagcacataaaacccttccggcaatgacgatgggttcctatcttcatcttcaaggggatcgaatcgatgcgaagcgtttgaaaaccttgctgacgatgcttcaaagtagttcgccctcttatccaattatggcctcattagatgtggcaagagcttatgccgaggagatcaaaggaaaagggacattgggtgtaatcatgaaagaactgacagagttgaaagatcagttcaaccttctgaatcaccttgaagtggttgagcctgaatcgttgccctccgatcctttaaaatgcgtcattcgatcaacaaaaggactgacaggttacgaactaaagcaggtgcttgaatcagtggatgttcatccagagcttgcggacgaacatcaagttttacttgtacttagcttagaacagaggaaaaacgttcctttcaagcggatcgagcaggctcttaagcaaagtaattcattgctcaaagggaaaaaacatatccaaaatgaaacggtatctattgagactgatatactaaatcaagacatagaggctgtcccatttgaacaagcagcagaccgggtgagtgcagaatccattattccctatccacctggtattcctttgatgattaagggagagcgcattgaaatagaacaaattgaggcgttaagccgtttgcttggtcacgaggttcatattcaagcaagtcaggtcattcatcagagaaaattatatgtttatatagaagaggagacactatgagcggtatgtttattacgtttgaagggccagagggcgccggaaaaacgacagtgatacgaaaagtgtacgaagaaatggaacgtcaaggatatgcagtgatggcgacacgcgagccgggcggcattgacattgctgagcagatccgtgaagttattttaaatgaaaaaaatacaaaaatggatgcgaaaacagaggcattgctgtatgcagcagcaagaaggcagcatttggctgaaaaggtagaaccggcattgcagcgcggagagactgtcttatgtgatcgttttgttgatagctctcttgcttatcaaggctatgcgagaggacttggaattgaccaagtcagatcaattaacgactttgctattgatggcacgatgccgcaaatgacaatttacttttccattacacctgaggaagggctaaagcgaattcacgccaatctaggaagagaaaagaaccgattagacatggagacgctgaatttccaccagttggttagagaaggctatgaactgcttattgcgcaatcaccagaacgattccgcgttgtggatgcttctcagccgatgcaggatgtctatgaagaagtacttcgagtgattcaggacacattaaagaaaaatcaaatatgacctcattcccaatcgttgttataatatagaggaagacatcggcatgtcacctgtgcctaaaacaaaggaggccaatcaaatgaaattaattgttgccgttgtacaggaccaagatagcagcaagttgttgaaaatattgactgaacatcaattcggcgtgacaaaattagcttcaactggtgggtttttaaagtctggaaacacgacttttatcattggttgtgatgatgtccgagtggataaagcgttacagcttataaaagaaaattgccgtaaacgtgatcaaatgattgcacctgtatctccaatgggtggtaacgcagattcatatgtaccataccctgttgaggttgaagttggtggagctactgtctttattctgccagttgaacaatttcatcaattctaaggatgggttgctgtgaaaattaatcaagatatgcggctgcttttagaaaagcgtgaactccaaggcattaaaggaagccaaacatctgcctcctttaaagcatcgatggagacgcaaagcggcaaaatgcgcttagagcagctgacggttatgctaagtgatatcgaagtgttcggtaaaaagctgacaaagtcacgaaacttaaaggacttggctaggtttaaaggtcttgtgaagcgctttgtgaaagagacagtcgataatggattaaatatagaaacatcaagaagctttgacatttatggcaacacgcgtacactcgctttagtcaaagcattagatgaaaagctgattgaattaacagaggatatgatggaccaagagaagccatctattgatttgcttgaacgtattggagaaataaaaggtttattgattaacctttacacatagagagtgataacatggcaattagctgggatgacatgaatgatttgcagccgcgcgtcatgcggctgatttttaatagtattgataaagaccgacttgcgcatgcttacttatttgaaggaaaaaaagggaccggtaagcaggatgctgcgatgcttttggcaaagagctttttttgcttgaaatcaggagtgaaaccgtgtgaatcctgtcaaaactgcaagaggattgaatcaggaaaccatcccgatttacatctcgtgcagcctgatggtcaatcaattaagaaagctcaagtacaggcattgcaagaggaatttacaaaagcaggtgtggaatctcaccgaaaaatgtatatcattcttcatgcggacaaaatgacggtcaatgccgcgaacagtttattgaagttcctagaggagcctaaccgggaaacgatggcaattttaatcacggagcaatcgcataaaatgctggatacgattatttcaagatgtcagatgctcagctttcagccgctgcaaccacaatccttggagcagcagctattacaagaaggcgtatctcagcatcttgcaaggcttttgtcgaatttaaccaacaatttagcagaagcactcgaattaagtcgaaatgatcagtttgcagagtctagagcgaaagtgataaaattgtatgaagtcttacaccagcgaaaagaacatgcatttttttatatacaggatcaatggatgccttttttcaaagagaaagaccttcaagaaacaggtctggatatgcttttatttatatatcgtgatgtattgtcgattcaaataggaaatgaagataaagtcatttatcaagacttattccagacaatgaagcagcacgcgctgcattccacacagcagatggtgacgaaccagatccttgctgtattagaagcgaaaaaaagacttcaatccaacgtgaatgcccaagggctgatggagcaattggtgttgatgttgcaggagggataagcttgtacaacgtaattggtgttcgctttaaaaaagcgggcaaaatctattatttcgatcctaatggatttcatatagaaaatgatagttgtgtcattgtagagacggtcagaggagttgagtacggacaagtggtcatcgctaataaaaaagtagatgaacacgatgtcgttcttcctctgcgtaaggtaattcgtgtagcagacgaacgagaccggctcatcgttgaggaaaacaaagaagcagcgatgacagcctttgatacatgtcttcagaaggtaagtgaacacggtcttgaaatgaagctggttgatgttgaatttacttttgaccgaaataaggtcattttctacttcacagcggatggaagagtagatttccgtgagctagtgaaggatcttgcatcgatcttcaaaacgagaattgaacttcgccagattggtgtaagagacgaggctaaaatgctgggtggcataggaccttgcgggagaatgctttgctgttcgacattcttaggagactttgaaccagtatccattaagatggcaaaagatcaaaacttgtcgctaaatcccacaaagatttcagggctttgcggtcgtttgatgtgctgcttgaaatatgagaatgatgagtatgaaacagcgaaagaacaattgccggatatcggtgaaacgattcagacatctagtggctctgcaaaggtagtagggctcaacattttagaacgaattttgcaagttgaattaaccgggcaagaaaaagtggtagaatatacttgggaagaattattacaagaaggcgttgtatctgcacaaacaactgagtaacgaggtgtgccaccttggataaaaaggaactatttgatacggtgatcaatttagaagaacaaatcggttctctttatcgccagttaggtgatttgaaaaatcatatcggtgaagtgattgaagaaaatcatcagcttcagatggagaatcagcacttgcgtgaacgtctggatcagtccgatcgggacaaatcgtctgagacagagaatgattctgctcagaaaccaggtcattctgatataggagaaggtcatgataacctggctcggttatatcaggagggcttccatatttgcaatgtacattatgggagcatacgtaaagagggagactgtttgttctgtctgtcatttttaaataaaaaatgagaaaaggcttccgctgaatcggaagcctttttcacaggaaaagaaaggatacatcatggtttcgttaagagaagatgaacgattagattatttgctcgccgaagatatgaaaattattcaaagtaaaacggttttcgccttttcattggacgcagtgttattagcaaaatttgcgtatgtgcccatccaaaaaggagagatcattgatctttgcacgggaaatggtattgtgccattgctgctttcgactcgatctaaggcctccattactggggtcgaaattcaagaacggttgtttgatatggcaaaaagaagtgtggcgtataatcaatttgaaaagcagatagaactgattcatggtgatctaaatgatatgccagcacgctacggcaatcacaaagtagatgtcatcacatgtaatccaccatattttaagacaccttctaaagaagaaatcaatgagaatgaatacttggccattgctcggcatgaaatccattgtacattagaagatgtcattcgtgtttcttccacgctgctgaagcaaggagggaaactggcgatggttcatcggccgggacgactgcttgagattgtggaattgatgaagaagtaccgaattgagccaaaacgaattcaatttgtttatcccaaacaggggaaagaagccaataccatcttagtagaggggataaaagatggaaaaccagatctgaaaattctcccgcctctttttgtttatggagatgatcaagagtatactgaggaaatcaggacgatactgtatggagaagcataatcattatttctatgtattgaaatgtgcagatggcagcctatatgcaggttatacaaatgatttacaaaaaagactgacgacccacaatagtggaaagggagcaaagtatacaagagcaagacggccagttgagctgtattatcatgaatgttttgcaaccaaaagagaagccatgcagcaagaatatcgtttcaaaacgtggacacggaaaaagaaagatctttatatagaagaaatgcgtattgaaaaggaggcggcacatgaaaacacagaaaagctttgatgatcaatcagatatgggtattctatatctcgtcccaaccccaattggcaatttagaagatatgacgtttcgagccatacaaacattaaaagatgtagactatattgccgcagaggatacaagacaaacgaaaaaactctgccatgtttatgaaattgatacgccattaacgagttatcatgagcataacaaggacagcagcggtcacaagttgatcgaatggttaaaagaaggaaaaaacatcgcactcgtgagcgatgcaggtttaccgacaatttctgatccaggtgctgaagtggtccgagactttacgaatatcggcggttatgtcgttccattacctggagcaaatgctgcacttacagcactcattgcatcagggattacaccgcagccatttttcttttatggatttctcgaccgacaaaaaaaagaaaagaaaaaacagcttgaaactttgaagaagcgtcaagaaacaatcattttctatgaagcgccccatcggttaaaagaaacgctgactttgatgaaggaagtgtggggcaaccggaaaattgccattacgagagaactgacgaaaaaatttgaagagtttgttcgtggagatttagagtctgtgctgacatgggcggcagagaatcaaatccgaggtgaattctgtcttgtcgtacaagggaacgatcaagatgaagaagagctaaatgaagaagcctggtggaagcccttatcagaaaaagaacatgtgatccattacatagaagaaggattaacgtcgaaggaagccattaagcgtacagccgtcgaacgtggtgtaccaaaacgcaccatttacgatgcttatcatattgaacaataaagaaaggttcttgcaaacggtgcaagaaccttttttatatcaaacttatttttgtgattgaagttggttttggatttcgttaatgatttgctctgcaccttcacggctaagaactaatttaccattagcaagtttaaggttatcgtctgatacttcacctgtaacttggcaagtcatgtttggtttatatttttttaggataattttttcatcatcaacataaatttccaaagcgtctttttcagcgattcctagagtacggcgaagttcgattggaatcaccacacgtcctaattcgtcaactttacgtacaatacctgtagatttcatcttcattctcctcccaaagagttcttattcttaatataatattatcttcgtcattattcgacaaattccttacattcatagcataacaaggtttccataaatcgtcaatcattttgtttactattgtttgtaaaatatgactcttaaagtcaaaagaccttgaaactactgatttataaggattttgcggctcttttctatgaaaatataagaaatgacgagctcagattaacaagacttttgccctaaattagacaattgtaaatctggaaatagatttcttacgacaatattcgacaaaatgtcgacaggtttgtcgtttttttcgaaaaactcatctttttcgatcatttcatcttgttctatgtatatatgcttgatcttaaaggctaagatggtatcatagagaaagcacaagtgcaaaatttaattaatggatctaacacattttcatgtaatgataataaccgctctcgtccattgggcgggagtttttgacatttacacacacgcaggaggttccaacatgccggaaaagaaaaaaacgttctatctgacaacacctatttactatccgagcggaaaattacatattggacatgcttatacgacagtagcaggggatgctatggctcgttataaacgtcttcaaggctatgatgtgatgtatttaacgggtactgatgagcacggacaaaaaattcagcaaaaagctgaagaacaaaacatcacaccgatcgagtatttagatccggtcgtagcagacattcaatcactatggaagaaactcgacatttccaatgatgatttcatccgtacaacagaaaaaagacatacgaaaatcattgagcaagtatttcaaaagctgcttgatcaaggcgatatttatttagatcaatatgaaggctggtacagtattccggatgagacattctatacggaaacacagcttgtggatgttgagcggaatgaaaagggagaagtcactggcgggaaaagccctgacagcggacatcctgttgaattaattaaagaggaatcatatttcttccgtatgagtaagtatgcgaatcgtttactagactattacgaaaagaatccaacgttcattcagcctgaatcaagaaagaatgaaatgatcaataacttcattaaaccaggtttagaggatttggctgtatcaagaacaacctttgattggggaattaaagttccaaacaatccaaagcacgtcatttatgtatggattgatgcgttgttcaactatttaactgcgattggttacggaactgatcaggatgaaaaatataaaaaatattggcccgccaacgtgcatctcgtagggaaagaaattgttcgtttccatacgatttattggccaattatgctgatggcacttgatctgccgctgccgaaacaaattttcgcacacggctggctgttgatgaaagatggcaagatgtctaaatcaaaagggaacgtagtagatccggtcacattaattgatcgctacggtcttgatgcccttcgttattacctccttcgtgaagtaccatttggtgcggatggtgtgtttacaccagaaggattcgtggaacgtgtaaactatgatcttgccaatgatttaggtaacttgcttaaccgtacagttgcgatggtacaaaaatattttgacgggacattaagcagctataagggtccagttaatgagtttgatgaggagcttaaagcagtagctgagcaaacagtcaaagcctatgaagaagcaatggaaaaccttgaattctcggtggctctctcaaatgtttggacattaatcagcagaaccaataaatacattgatcagacagctccatgggtgctggcaaaggatgaaacaaaacgaaaagagctgcattctgttatgtatcatttagcagaatcattgcgcatcacagcagtgctcttaacgcctttcctaacgaaaacacctgagaaaatcttcttccagcttggcattgaagaagagaaacttaaaagctgggatagcattctatctttcggtgcgattcaacaagcgacggtacaaaaaggagagcctttgttcccgcgtttagaggttgaagaagaagtagcatatattaaagagaaaatgcagggaagtgcaccaaaggtagaagaagagaaagtagaaatagaagaaacagaattacctgagctgggagcagaaattgcatttgatgatttctcaaaagttgatcttcgagttgcacaggtgctggaagcagccccagtgaaaaaagcagatcgtctcctaaagttgcagcttgattttggatttgaaaagagacaaattgtttcagggatagccaagcattatcaacctgaggaattagtagggaagaagctcgtctgtgtagcgaatctcacaccagttaaactcagaggggaaatttcccagggaatgattttaactggagaaactggcgggaaattgcaggttcttgaagtggatcaatctctagcaaatggaacaaaaattttataaatcaacaaaggtgttccacgtgtaacatttcgtcgaacaccttttgttttttggaagaattgtcgaaaggagcaatcaacgatgttatttgatacacatgcccacttaaatgcggaacaatataatgaagacttagagcaggtaatcgaaagagcgaagagtgaaaaagtcgaaaaaatcgtggtggtagggtttgatcgcccgacaattacgagagcaatggaattaattgaagagtatgatttcatctatgcagccattggctggcacccagttgatgccattgatatgacagatgaggatttgctgtggatcaaagaattatctgaacatgaaaaagtcgttgcaattggagaaatgggtctggattactattgggacaagtcgcctaaagatgtgcaaaaagaagtctttagacgtcaaattgctcttgcgaaggaagtgaatcttccgatcattattcataatcgtgacgcaacggaagatgtcgtgacgatcttaaaggaagagggagcggctgaagttggtgggattatgcattgctttactggcagcctagaaatcgcaaaagcgtgtatggatatgaacttttatatttcattcggtggacccgtgacttttaaaaatgcaaaaaaaccgaaggaagttgttaaggacataccaagtgaccggcttttaattgaaacagactgcccatacttaacgccagcgccatttagagggaaacgtaacgagccgagttatgtgaaatatatcgcagaacagattgcggagttacgagaaataagctttgaagagcttgctgaattgaccacaaaaaatgcaaaaaaagttttcggtataaactgacagtatatgatgtcaatccttgtttaagcttgtccatttgtgaaacataacgaaaatgttctacacgtttaagcctcttcataggataagttgtcgataagtctttcttcccttccttccattaaactcccataataggagtacaatcgagcatttttgtacagtgggtggaagggttgacaggttttgagatactctatataatctctccgaggagaaggaggcgtttttcatcgtacaaaaaatgaaaaatctgttttctgtaaagctaggaaaaggcaaggttttattactagttgtttgcttgcttttagctggaactgggacggcttacggtgcgcatgagctcactaagcagtctattaccatttcaattaatggtaaagagaagacaattcgtacacatgaagagacagtagcacagctgctttcagaccttggaataaagaccaaggcggaggatcatatctctccaagtctaaatacaaagattgaagacaacatgaacattgtgtatgatgcggctataccggttcatctgaccctagatgggaaagagaaaacgatatggacaacagatcagacggttggagcattattgaagaatgagaagatagatattgggaagcacgatcaagtaactccaggaaagaatgacaagattaaaaaagatatggatcttgtggttgagcaggccttcgaggtcagcgtaaatgatggaggaaaagagaaaaaagtgtggaccacttcgactacggtcgctgactttttaaagcagcaagagctgaagctcaagaagcacgataagatcaaacctgcgttacatagtcatataactaaaaaaagcgcagatattcagatcactcgggtggaaaaagtcaccgatgtagtggaagagaaaattgcttttgataccaaacataaaaaggatcgttctcttgaaaaaggaaaagagaaggtgcttaaaaaaggtgaagaaggtaaattgaagaagcactatgccattgtgaaagaaaacggcaaagtggtgtctaaagaattaattaaagaagtgactgaaaaagatagcaaggatcgtttagtggccgttggtacacaagagtcccaaaaagagcctaaagcgacacctgccgtttcaagaagcaatgaatcgtcaggaaaagaattttatgtggcctcgacagcctatacagcgagctgtgctggatgtacgggcagaacgtcaacaggctataatttaaaatcaaatccaagtgcaaaggtcatagcagttgatccgagtgtcattccgctaggctctaaagtgtatgtggaaggctatggatatgccgttgcatcagacactggatctgctataaaagggaataaaattgatgtgttcgtcccgaataagtcggcagcttatcaatggggaaataaacgagtgaaaattagagtactcaaataaacacatcaaatcatttatatgaacagagggctttgcgcaccctctgtttttttggttataatagaagcactgttttctaattaattagacgcaaaaacaacatgaaaggtttcgttttttaaccaaaaaatgttttttgtttttgcaagtggaggaatacatgaaaatcaaagaaatcattgtggtggaaggtcgtgacgacactgcgagagtgaagatggcagttgatgcagatacgatcgaaacaaacggatcagccattggcgatacagttattcaacaagtacgtcttgctcaggagacgagaggggtcattatcttaactgatcctgatttccctggggagaagatccgtaaaaccatcgcagaagccgttcctggctgtaagcacgcatttttgccgaaacatcttgcgaaggcgaagcgggacaaaggaattggtgtcgagcatgcttccttggacagtattcgagaatgccttgcccatgtccatgaggaaatggaagtaacggaaagtgacattacattagatgacttatttgacgcaggccttatcggaggcgaatcatcgaaacgccgccgcgaacgactaggtgtgcttttaaatataggatataccaatgcgaagcagctgcataagcgccttcacatgttccaaataaccaaacatgattttattgcggccttaaagaccgtcatgcaggaggaagccgatgaataaagatatagcgacacccatcagaacgaaggaaatactgaagaaatacggtttctcctttaaaaagagcttggggcagaactttttaattgatacaaatatactcgatcgtattgtcgatcatgcagaggtgacggatgagaccggcgtgattgagatcgggcctggtatcggtgcattgaccgagcagctcgctaagcgtgcaaagaaagtcaccgcttttgaaatcgatcagcgtttattgcccattttaaatgatacactttctccatatgataatgttacgatcattcatcaagacgtattaaaggcagatgtgggaaaggtcatcgaggaaaattttgctgactgtaaagaagtgatggttgtcgccaacctaccatattacgtgacgacaccgattattatgaaactgcttgaagaaaaccttccattgaaagggattgtggtcatgcttcaaaaagaagttgcagatcgtatggccgctgtcccttcatcaaaggaatacaattcactttctattgcagttcaatactatacggaagcgaaaacagtgatggttgtgcctaaaacggttttcgttccacagccaaatgtcgattcggctgtgatcaagctgaccgttcgtgaaacgcctgccgtctcagtagaaaatgatgagtttttctttcagttgattcgtgcgagctttggtcagcgccgaaaaacattgatgaataatctcatgaacaacttacctgatggaaagcaacataaagcaattattgaagaagcacttcaaacagcagacattgatggaaagcgccgcggcgagtcattatccattgaggaatttgcccgtttgtcgaatgttttacaagaagctctgtcttaagagctttttttgtttttcaccacttcgcttgttcgggcataggctagaaagaacagcacatatgaaagacgaacatatttagcgcaagacgataccaacaggatatgagcctgattgtggagtgaaaagcatgcaatttcaaataggagatatggtgacaagggcatcctatcaaatggatattttgtttcgaatcattcgaattgatgagactgatcagcacgaagccaccgccatattgcatgggaatgaagtgaggctgattgctgatgccaagttgtcagatctcgtcaaggttcaaaaagaggaacagctgactagagagaaaaatgacgaacgaaaaatcaatgaatcgctcgacttactaagacaggactatcagctgctgcgggaaaaacaagagtattatacttctggacaatatcagcatcaggagcagtattttcacatgcctggaaaggtccttcatttagatggagatgcttcatacttaaagaaatgcttggatgtatatgaacgaattggtgtacctgtatacggtgtgcattgccatgagaagaaaatgccaagcatgattgactcgttaattgatcaatatcgaccagatatattggttatcacaggacatgatgcgtattccaagcaaaagggcggcgtacatgatatcggtgcctatcgtcattctcgtcattttgttgaaacggttcaaaaagccagacggaagatccctcatttagatcagcttgtgatctttgctggtgcctgtcaatctcatttcgaatcattgatccaagcaggtgccaattttgcgagctctccttcccgtgtgaatatccatgcgctcgatcccgtctatatcgttgcgaagatcagcttcactccatttgtagatcgaatcaacgtgtgggatgtgctccgaaatacattaacaagagaaaaagggctgggaggcatcgagacgaagggcgttctaagggtaggtatgccatataaaagagatcatgaatcgacataacccgactgatttcagtctggttttttttatgttcaaaaagaaattgcaaaaggatacataattcaccggaaattgagaaaaatagggagaagaaaaggtagaagtttgtcaaaattattttgttgacaatggctcgtgttcgttgatataatttaatttttatttgacaaaaacgggccgttgttgtataattatctcagtgaggtggatgcaatggcgaagactttgtccgacatcaaaagatcgcttgatggtaacttaggtaaacgtttgacgttaaaggctaacgggggccgccgtaaaacaattgagcgttcgggcattttagctgaaacgtacccttctgtatttgtgattcaattagatcaagatgagaattcgtttgaaagagtttcttatagttatgcagatatactgactgagacggtcgaattaacgttcgatgataccgctagctcagtcgcctattaatgggcagtaaactttttgtttactgctttttgttttgcctttttttctgaatgtgaatgggagtctgtccattttttgaaaggggtaaaagaaaggattcgatacaaaataagaaagccacacaagcagtggcactgattcgaattctcgactaaaggggctgtttcgtttgggtagacgccgaggcattatgtcagatgagttcaaatacgagctggcgaaggatcttggattttatgataccgtcaaaaatggaggctggggagaaattcgtgcgcgtgacgcaggtaatatggtcaaacgtgccattgaattagctcaacagcacatggctcaggatgagaatcaacgatagaaaaacggtcagggatacctcgggtgtctctggctttttttgatgaaaaagtcagtgtgctcggcgtaaaagcctatattcatcagatccatcaaatgtgatacaatattgatacttatgtttagatggagaagtaggtgaaatgtttgcgtattttagaaaaagcaccggcaaaaattaatctctcacttgatgttcacggaaagagaccggatggatatcacgaagtggagatggtgatgacaacaatagaccttgcagatcgactagagttgacggagctggacaaggatgaaatccgtgtatcatctcataatcgattcgtgccagatgatcagcgtaatttggcttatcaggcggctaaattacttaaaacaaggttcggtattcgaaaaggggtatccattgtcatcacaaaaacaattccagtcgcagcagggttagctggaggcagcagtgatgcagcggcagcacttcgcggcttaaatcgcttgtggaagttgaacctcacgttagatgaactagctgagcttggagcggagatcggctcagatgtgtctttttgtgtacacggaggcacagcactagcgacaggacgtggggaaaagctgaagcatattgcgacaccgccgcattgctgggtgattttagcgaagccggtgattggggtatctacagctgaagtctatagacaatatgacgcaagcaaagtagaacacccgaatgtaaagcgtatgattgaagcgattgaagcgaaagattataaagagatgtgcggctcactcggaaacgttctagagtctgtgacattaaagatgtatccagaagtagatatgatcaaaaggcagatgaagcgtttcggtgctgacgctgttttaatgagtggaagcggccctacagtatttggcttgattcaatatgaatcgaaggtacaaagaatatataacggactgagaggattttgtgatcaagtatacgctgtccgcatgatcggcgaacaaaatgcccttgattaaatccgtatattaagttatatttatcataaattattcgggttctgggggtaagttcatgaagtttcgtcgaagcggcagattggtggacttaacaaattatttgttagcccacccgcacgtactagtaccgttaactttttttgcagaaagatatcaatctgcgaagtcctccattagtgaagacttaacgattatcaaacagaccttcgaacagcagggaataggcacgttgcttactgtacctggtgctgctggcggagtgaaatatattccaaagattcacctaaaagaagcagacgacgtggtaaacgatatcggagaagctctatcgactcctgaacgtgtacttcctggcggttatttatatttaaccgatgttttaggtaatccatcaatccttgcgaaaatcggtaagctatttgcgaccatctttgcagaccgtgcgattgatgtcgtcatgactgttgcaacaaaaggtattcctattgcctattcggttgcgggttatttaaatgtgccggttgtgatcgttagaaaagataataaagtaactgaaggatcaactgtaagtattaactacgcgtcaggttcgtctaatcgaattcaaaccatgtcacttgcaaagcggagcttagataaaggatccaatgtcctgatcattgatgactttatgaaagctggcggaaccattaacggcatggtgaatttgcttgaggaatttaatgcaaatgttgcagggatcggtgttcttttagaagatgaaggcgtagatgaacgtctcgttgatgaatatgtatcgcttttaaagctttcaaccattgatatgaagcagaagatcattgagatcaatgaaggcaatttccacgagttttttcattcgaaagcttaagaattgaaaacatgtagttgaatgggagagattgatatgacaaaagttgttcaaaccaaacacgcaccagcagccattggaccttactctcaagggattattgtcaataacatgttttacagctccggacagattccattaacggcagctggagactttgtaaatggagatatgaaagaacaaactcatcaagtgttccgtaatcttaaggccgtacttgaagcagcaggtgcttcctttgagacagtcgtgaaagcaacagtttttatcaaagatatggaacaattcgcagaagtaaatgaagtgtacggtgagtatttccatacacataagccagctcgttcttgtgtggaagtagcaagacttcctaaggatgcactcgtagaaattgaagtgattgcattagtaaagtaaacaggcaatcttaacgaaagccgtttggtttcatcttatgcaggaaaagacatcatcatgatgtctttttttcacgaagagaatgtaagcgtcgtcacgaagatgacaaaaaatgtataaatatcccgatatttcaaaaaaagtttaaaaaaagagcaggagaatcaccacaatcgttgaatacctaagtaatgcttttatattgggaaaaggtggtgaactactgtggaagttactgacgtaagattacgccgcgtgaataccgatggtcgcatgagggcgattgcatccatcacgctggaccacgaatttgttgttcatgatattcgtgtgattgatggaaacaatggcttgtttgttgcaatgcctagcaaacgcacgcctgatggagagtttcgcgacattgcacatccaattaattcaagcactcggggtaaaatccaagatgctgttttaaatgagtatcatcgcttaggcgaagaggaagagacaattgaatatgaagaagctggagcttcttaataatacgtgaacctaaaaaggcagctttaagagaaaatggatgttttcttttaaatgctgtcttttttgcgttttttctcttgtttcttatgtctcccatccattagaaaattattgcacttcctcttgtatccttgaaatcaatccttatttaggatatatttttctatggataatagggatattggaggccaatcaatggataagcggttcgcagtgattttagcagcgggaaaaggaacgagaatgaagtcaaagctatacaaagtacttcatccagtttgcggaaagccaatggtcgagcatgtggcagatgaagcgttaaagctttctttaaccaagctagtgacgattgtcggtcatggagcagagaacgtcaaagagcagcttggagacagaagtgaatatgcacttcaagaagaacagctgggaacagcacatgccgtcaaacaagcaaagtcgttccttgcgcaggaaaagggaacaaccattgtcatttgtggtgatacgccattattgacagcggaaacaatggaagctatgttgagcgagcatcaaaaacatcaagcgaaagtcactattttaacagcacgtgcggaagacccggcaggttatggccgtattattcgtgacgaaaccggtgctgttgtgaaaattgtggagcataaagatgcgaatgatgcggaacgtcaagtgaatgaaattaatacagggacctattgcttttcaaatgaagatctcttccgtgtgattgagcaagtatcgaatgaaaatgcacagggtgagtactatttgccagacgtcattgaaatcttaaagaatgaagggcaaacggtagcggcatatcaaacaccgcattttgaagaaacacttggagtcaatgatcgtatcgctctatcacaagcagagcaattcatgaagcgacgtattaatcatcagcatatgaagaatggtgtgaccttgattgatcctgagaacacgtatatttcacctgatgcagtgatcggtgaagatacaacgatttatcctgggacggtcatcaaagggaatgtgaaaatcggtgcagacgccattattgggccaaacactgaaattgttgacagcatcgtcggagaccgcacagtgattaagcaatctgtcgtctgcgatagtgaggttggagtcgatgtgacaattgggccgtttgctcatattcgcccgttgtcgaaaattggcgatgaagtgaaaatcgggaactttgtcgaaatcaagaaaacggttttcggtgaccgcagcaaagcatctcatctcagctatattggagatgcagaggtcggaactgatgtaaaccttggctgtggatcaattacagtcaactatgatgggaagaacaaattcttaacgaagattgaagatggcgcatttattggctgtaattctaatctcgtggcaccagtcactgtcggaaaaggggcatatgttgcagctggttcaacggttacagaagatgtaccgcaggatgcattgtctattgctagagcaagacaagtcaataaagaagattatgtgaaaaatattcataaaaaataatccaaatacccggaggttaccatgtctaatcgttatgctgatgcgaatttaaagatattctctttgaattcaaaccctgaacttgcgaaagaaattgccgatcgtatcggagttgatgtaggaaagagctctgttaaacgctttagtgacggtgaagtccaaatcaatattgaagaaagtatccgcggctgtgattgttatgtcattcaatccactagtgcgccagtcaatgagcacattatggagttgctcattatggtagacgcactaaaacgcgcttctgcgaaaacggtcaatattgtgatcccttattacggatatgcacgtcaagatcgtaaggcaaaacctcgtgagccgatcactgcgaagctttttgcgaacttacttgaaacagcaggtgctacacgtgtcattgcacttgatcttcatgcgccgcaaatccaaggtttctttgatattccaatcgataatttaatggctgtgccaatcttaacaaactatttcgaacagaaaaacttgaatgatatcgtcgttgtatctcctgatcacggtggtgtaacacgtgcgcgtaaaatggcagatcgcctgaaagcaccaatcgcaattatcgacaaacgtcgtccaaagccaaacgttgctgaagtgatgaacatcattggtaacattgaaggcaaaacggcgattctcattgatgatatcattgatacagctggtaccattacacttgctgcaaatgcacttgtggaaaatggagcggctgaagtctatgcttgctgtactcacccagtattgtctggaccagcagtagaacgtatcacaaactctaaaattaaagaattagttgtgacaaacagtattcacttaactgatgacaagaaagttggaaaattcattccgctttcagttgggcctttgcttgcagaagccatcatccgtgtacatgaagaagaatctgtgagctaccttttcagctaattttctgattgaaaaaggccctaggcatcaagcttggggtctttttgctttcatcattctcggcaaataggtttaaaatgatttggttatgggtaattatgagagtagtgacaaaaaagaaataggatggtgctgaatatggcaactttaaaagcaaataaaagaactgacttcaaacgttccacactgcaaaaaatccgtcattcaggacacgttcctggtgtcatatacggaaaaaatacagacaacctggctgtttcattagacagtatcgatttattaaagaccttacgtgatgaagggaagaatacaatcattacgttagacgtgaacggtgaaacaaaatccgtgatggtcacagaattacaaacagacccgctgaaaaatgagcttgtccatgcagatttccaagtagtcgatttgcagcgtgaaattgaagcggatgtacctgttcagttgattggcgaatctaaaggagttaaagatggcggtgtgcttcagcagccactatttgaactatctattacagcgaagccaaaagatatccctcagcatatagaagcagatattacaaacttagaagtgaatgatgtcctaacagtcgctgatttgcctgttcagtcatcatatcaagtgaataacgatccagaagaagtcgtggcatccattttaccgcctcagcaatcagaggttcctgaaccagatagcgaagaggaaccaaaagaacctgaggccattaaagaaaaggataacgatggagaataactggtcatttagagacgtaaccctcccgcggttgcgtcttttgtgctagaatgaaaagaattcatacgttttacatgaggcaatcctattggctcattttttaggcgtgtgctttgtgacaaaggaggtttatggtttcatgattgcatttgttggattaggtaatcctggaaaagaatatgaaaaaacaagacataatgtcgggtttatgacaatagatgaattatcaaaaaaatgggacatccctttaaatcaatcaaagttccatggacaatttggaacgggatttgtttcagggcaaaaggttctacttgtaaagccgcttacatatatgaacttatcaggagaatgcgtgcgtccgctaatggattactatgatattccccttgaacagttgaaagtcatctatgatgatcttgatttgccaactggccgaatccgccttcgtacaaaagggagtgcaggcgggcataatggaatcaaatcgttgattcagcatttagggtcacctgagtttgaccgattccgtatcggcattggacgtcctcaaaatggcatgaaggtcgtcgattacgtgctaggacgcttttctgaagaggagcagcctgatattgcatcagccattcaggcgtctgtcgaagcttgtgaggcggctttaactaagccatttttagaagtgatgaatgattttaacaagaaggtataagaatgataagcaaagcacatactgatcataaaatctcagcaggggaggatcacgtatggctttgcattattactgccggcactgtggtgtaaaggttggcagtttagatgaatccgctgttcaaagtgaagcacttggatttcatcacttaacaaatgaggaaagaaacgatatgatttcttatagggaaaatggtgatttgcatgtacaaaccatttgtgaggattgccaagaggcgctcgaaagaaatcctgattaccatcagtatcatacctttattcaataaaaagctttggtgtagataatagaccaaagcgtttttctgttttaaacaagcagggaggaggagccaaatgaaaaatatacaatcatttatcaaacaaagtgatgattttcagtccatttttaatgggctaaaggaagggttaaaagaacaactgctcgccggactatcaggctccgtcagatctttatttacagccgctatatcagacgaacttaagcggccgatgtttattgtgactcacaacttatatcaagcgcagaaggtcacagatgatcttgccagtgtgatgtcagatcgctcggtccttctttatcctgtgaatgaactcattgcttcagaaattgccgttgccagccctgagcttagagctcagcgtctagatgttctgaaccggctggcgaatggagaaaaccccattatcgtcactccggctgctgcggtgcgtagaatgcttccgccagttgagctctggaaggagagtcagatccatttaaagcttggtgaagaaattgatttggaggcgttttcaaaacaacttgtacaaatcggttatgaccggacgtcgatggttgctgcgcccggagattttagtgtgcgcggaggaatcattgatatttattcgttaacggaagatcatccaattcgtattgagctgtttgatactgaagtagactcaattcgaacgttccactcggatacacagcgttcattagaaacacttcaagagattaaaatcggtcccgcaaaagagctgattgtgagagggcctgaacgagtgagagccattgaacagcttgatcaaggacttgcgaagagcctaaagaaattcaactcagaccagcaaaaagaattgctgcatcaacatatttctgctgatcgagagaagctgctagaaggaatcgtgacacaggaaatgacgaagtacctgtcctatttctatgaaaaacctgctagtttgctagattacacttcacaggatacgattattattttagatgaaattagcagaattcaggagatggaagaacagcttgagcaggaagaagctgattggacaattagtctgcttgaagaaggcaacatccttcatgatttatctctttcttttccgttccaacaactaatcaatcagcaatctcggtcgattctgtactactccttgttcctgagacatgtccagcagacaaatccgcaaaatatcgtcaatgtatcgagtaagcaaatgcagaatttccacgggcagatgaatgtgctcgcaagtgaaattgaacgctacaaaaaacaacaatacacggttgtcttcttaggtgcggatgaagagcgtacagacaaattgtcttctgtcttacatgattatgacattgaagctgctcttgccaagccggacgcagagcttgtaagcggacaggtgtatattttacaaggtgagctacaaacaggctttgaactgccgttatcgaaaattgccgtgatcacagaaggcgagctcttcaaaaaacgtgtgaagaagcaggcacgtaagcaaaagctgaccaatgcagagcgaattaagagctattccgagcttcaagtcggcgattatgtggtgcacattaaccacgggatcggtaagtatttaggaattgaaacgcttgaaatcggcggcattcataaagattatttaaatattcattatcaaggaagcgacaagctttatgtaccggttgaacaaattgatcaggtgcagaagtatgttggatcagaaggtaaagaaccaaagctgtacaaactaggcggcagcgattggaaacgtgtgaagaaaaaagtggagtcatctgtacaggatatcgcagatgatctcattaagctgtacgcagaacgtgaggcaagtaaagggtatgccttctcgcctgatcatgagatgcagcgccagttcgaatcagcgttcccttaccaggaaacagatgatcaaatccgttcgattcatgaaatcaaacaagacatggagcgggagcgtcctatggaccgcctgctttgtggagatgtgggatatggaaaaacagaagtggcgattcgagccgccttcaaagcaattgctgacgggaagcaagttgctctgcttgtgccgacaactatcttagcgcagcagcattttgacacgattatggaccgattccaagactatcctgtcaaaattgctcagctgagccgtttccgtacaagaaaagaaacaaccgagacgttaaaaggtttgaaaaacggaacgatagatatggtgatcggcacacaccgtttgctttcgaaagatattgtctataaggacttaggtctgttgattattgatgaagagcagcgttttggtgtgacgcataaagagaaaattaaacagatgaaagccaatatcgatgtactgacattaacggctacgccaattccgcgtacgctgcatatgtctatgcttggcgtacgggatttatcggttattgaaacaccgcctgaaaaccgtttccctgttcaaacctatgtggtcgagtacaatggcgctttagtcagagaagcgatagagcgagaactagcacgtggtggtcaagtgtacttcctgtacaaccgtgtcgaggatattgaacgcaaagcagatgaaatctctatgctagttccagacgcgaaagtcagctatgcacatgggaaaatgagtgagaacgagctggaatcagtgatgatcaatttccttgaaggtgaatcagatgtattggtcagtaccaccatcatcgaaacgggagtcgatattccgaacgtgaacacgctcatcgttcacgatgcggataaaatggggctttctcagctgtatcagctaagaggacgagtaggacgctcgaatcgtgtcgcatatgcttatttcacgtatcgaaaagataaagttctgtctgaagtagcagagaagagacttcaagctattaaagaattcacagagctcggatcaggatttaaaattgcgatgcgtgatttaacgattcgaggagcaggaaatttacttggtgcacagcagcatggattcattgattctgttggattcgacctctattcccaaatgctgaaagaagccattgaagaaagaagaggcgatacaacggctcaagataaattcgaaccggaaatcgatctacaaatcgatgcttatatccctgacacttacatttcggatggaaagcaaaagatcgagatgtataaacagttcagagcgattggatcaattgaagagcgaaaagagcttcaagatgaaatgatcgaccgattcggtgaatatccgcaagaagtggcggatttgttcacaattgcgacgatgaaagtatacgcagtgcaggaacgtgtcgaattgatcaagatggagaaaggcattgtcagactcacccttgaagagcaagcaagcagtgacatcgacggtcaaaaattatttgcacttggcagtaaatatggccgtgatattggcctaggaatggaaggcagcaagctaattatttctgtccagacgaaaggtaagaagacggaggaatggcttgacatcgttctgaatatgctacgaggtcttcaagatgtgaaaaaggaaaccattccatcttcataaaaatttgtttgtctctcgtgtatattacgtttgatgtgacggatactaatctcagggtcaagtggtgaatgttgcataaagtggacgcttttgttccattcacccaacacatcatcaaacgaaagagaggcagcagtgaatgaaagcaactggaattgtacgccgcatcgatgatctaggtagagtggttattccgaaggagattcgcagaacattgcgcatccgggaaggagatccacttgagattttcgtcgaccgcgatggagaagtaattttgaagaaatattcgccgattagtgagctaggagactttgcgaaggaatatgctgatgcattattcgacagtttgggtcattccattctgatttgtgatcgagatacgtatattgctgtatccggcagttcgaaaaaagagtacttaaataaatccatcagtgatttacttgaacgaacaatggaccagcgtaattctgtattagaagaaagcaaaaaagaaattcaacttgtcgatggtattgatgatgacgtatctgcttataccattgcacctattgttgcaaacggagatccgattggcgccgtcgtcttattttctaaagagcgttcaatgggggaagtggagcataaagcggcagaaacggcagctggcttcttagcccgtcaaatggaacactaggtctaataattgtatatcattttgataaaacaaaagaatgccgatgaaatcattttgattttgtcggcgttttttatatggaatgaaacaaaacgaggaatgtgccgtctactccttagaaagaaacggcttttcattcacgtatgatataatgagtgcgtttaactgtagatctatttttaaaggagtcatccatgaaaaatgctgtgaatcagccgcattggcttttccaaggtgcggtgattttgaccatcgcaggcttgttatcaaagatattaagtgccgtttatcgtgttccgttccagaacatcgtaggagacactgggttttatatttatcagcaagtgtaccccttccttggtattgcgatcatgctcggcaccacagggtttcctgtcatggtgtccaagcttctaagtgaccatggggaagagaatcgacagatcattacacgggtatccttggtctatatcaccttactgagcctagtcttatttctttgtctttacataggagcaggcagaattgcgagccttatggcggacagtcaattgatcctgcttatccaaatgagtgctttcgtgtttttatttctgccgcttaccgtgatgctgagaggcgtttttcagagtgacggtatgatgcttccaacggctgtttctcaattggttgagcagctcatcagggtaggcgtcctgcttgttttatccttctatttcgtcaagcatggttattcgctttatgaaacaggggcgggtgcagttttctcttccatagcgggaagtgcgacctcgcttatactgcttctttttctttggctgacttaccgaaaacagtcttctacacgtatggcagtcaagcaggcgacacttcggaaaaaggatgttttgaagagtttggtgctgtatacattgacgatttgtgtcagcggactgctcattttatggatgcaaatgattgatgcttttcatctgtatgcgttgctgcgcagtgagggactgagtgaagccgcggcaaaggcggcaaaaggtgtgtatgaccgagggcagccgtttttacagctagggacagtgtttgccattagcatcgggacttctcttgtgccatttttatcagcggccatgaggaatggagagcatgaagtgatcaggcaaaaagtacggacatcgtttaaaaccacgttggttttagggattggttcagcagttgggctgatttgtattctttcgtcagttaatacaatgctttttcgtaatgatttaggaaccgatgcgctgcaaatattctgtatttccatcgcatttacatcgattgcgattacgcaagcagctttacttcaagggctcgggcatactgtgtatccggctgttgtggtactgctcagtgtgctggtgaagtggatacttacgcttgcactggtcccgctatttggcatctacggtgccgcatggtcaaccgtgtgcggttttcttgctgccgctctgctcaatgccgtttatttgaaacataaagggtggatttcgttgagagagctgttcccagtgaaaattcttttatcagccgctttcatggccattgtcttaatagggtatcaggcgctgttttcttgggtcattccctttgaaaaacgtcctttttccgttttagagagcctgacgtcagtttttattggtggtttcgcctttttatatagtattcttaagctagaagtatttacggacgaggaatggagactcattccattaggagaaaagattttatattttaaacagatgagagggaatcaaaatggcaggtaagattaccgtcgtcggtcttggggcaggcgacatggatcagctgacgctcggtgtttacaagcagctgaagcaggtgaaagaagtatttatgagaacgcaggaccatccgctgaccgcagagttgatgcaagaggtcccatcgctgaccttttttgatgagatttatgaaaagcacgatcagtttgattcggtctatcaggaaatcacggaaattttatttacagaggctgctgaaaaggagattgtgtacgcagtaccaggtcacccatttgtcgcagaaaagaccgtccagctattagtttctcagcagcaagagcgcgggattgaggtgtctgttgcaggtggacaaagctttttagatgcgacgtttaactccttgcagatcgacccaatcgagggattccaattcgttgacgcaggagatatgagagcggacgatctgaaattgacccagcatgtccttatttgtcaggtatatgatcagatcaccgcttcgaatgtgaaactcacgctgatggaaaagcttccagacgattatgaagtctatattgtgactgcggctggaagcagcctggaacaaattactgccgttcctttatttgaacttgatcgagatgtgtcgataaataacttaacaagtgtttatgtacctccgattcaagatgaaaagctgctttatcaacaatttgacaccttccgtaacgtcatccgtacattaagaggtccgggcggctgtccatgggatcaaaaacaaaccaatgagtcactgaaaccctatttaattgaagaatgctatgaactgcttgaagcgatagatgaagatgatccagaccatatggtggaagagctcggagatgtgatgctgcaggtgttacttcatgctcaaatcggtgaagatgacggctttttctcaattgatgatgtcatccagcatgtcacagaaaaaatgattcgtagacatccccatgtgtttggcgacacaaatgtttctgaagcagaagaggtggtcgtcaactgggaaaaaatcaagcagcaggagaaaccggagcgggcagcctccatgttgcaatccatcccggcgacgcttccagcactaacaaaggcatataagctccaaaagaaagccgccaaagtaggctttgattggacagatgtgaaagatatttggaacaaatacgaagaagaaaagcaggaatttctcgttgaagtggcagagaagccggacgaaagtgcaacgaagcagatgaaagatgaatttggagatcttttgtttgttctcgtcaacattggcaggttctatcagctagagcctgaaacggcgctcgcttccgccaacacaaaattcatgcgacgttttcagcatatcgaacaaaaagcaaaggacatgggacgttcattagaggacttaacgctagaggaaatggacgatctatggaatgatgccaaacatatagaaagaggtgagtaaacatgagattagataaatttttaaaagtgtctcgtttaataaaaagaagaacattggcaaaagaagtcgctgatcaaggcagaatttctattaacggcacacaggcgaaagccagctctgacgtgaaagaaggagacgagcttaaaatccgttttggtcaaaaactagtgacggttcaagtgaacgagttaaaggacacaacgaaaaaagaagaagccgctggcatgtatactgtgctaaaagaagaaaaaacagcggaatagggcttgttctaaatgatcctcctgtcacatacaatgcagtaacaatgcaagtatgagatatgggggatgtataaatgaatcaatattataatcaacctcaaggcacgaagctgtcatcagaagcggaacacaatatcacaatgcgaaacagaaagcatttagatattaccggcgtcaaacaggtggaaagctttgataatgaagaatttctgcttgagacggtcatggggattctcgctatccgtggagaaaatctgcaaatgaaaaacctagacgtcgaaaaaggcgttgtgtcgattaaaggacgtgtctttgacttaatttatgtagatgagcagcacggggagaaagctaaaggattttttagcaagctgtttaaatgacgctgacagtccagttttatacgatgctttcgatggtagcgatgggcatctggctgggcgcatcgcttgatacgtacaagctgtttgtgaatcgggaaaagacagcaaaatggcttttgatcatacacgatctccttttttggctggtacagggactcttattcttttatgttctgctgctgacaaatgagggagaattcagggtttatatctttctagctgttgcactaggtttctcgatgtatcaggcattgatgaaacagctgtatatgaatattctcaagtttatagtgatgtgtgtgtatcaagccgctctcatcttgaaacggctggtcaagtccatcgtcttccagccaatccgctggctgatgaccttaatcataagtgctattatgttcttgctccacttgctcttacgtcttgttcattttacgtttcggctcgtgtggaaggtgctgtccattgtttgttatccgctcatctggttacttaatgtgaccatcattcatcggattcccgaaaaatggcgaacatcaatgagattgtttttctctaaaggagcaggaattttacaagggaccaagaaattatctggtaccatcaaaacgaaatggaaacaattctggacaaagtaagagaggaggccttcaaccttgaacaagagaaaaagaaatatcgcacaaattcaaaatgattatcaaaaacaaatggaacagcaagcacagcgcttaaaacgcaaacgccgtggactcctaagaaggcttaccgtgtttggtgtgatcgtgctcatgtttgctgtcttggtgacaagtgccctctggtcgcaatcgtcttcattaaaggaaaaagaagagaagaaggttgcactcgaaaaagaattgaagcaattacaaacaaagcaggaagatatttctgatgaaattaaaaagctgaaaagcaaggaatacgtactcgaactggcacgacgggactattatatgtccaaaaaaggcgaaaaaatctttgatgtgggcaataagagcgattagccttgttgacacttaaaattcagtttatgtataattgaacaaatgagatttttttataagtctaaggaggagcactttttttatgtcgattgaagttggcagcaagttacaagggaaagttacgggcattacaaattttggagcttttgtggagttgccaggcggttcaactggtctcgttcatatcagtgaggtagccgataactatgtaaaagatattaatgagcatttaaaagtcggtgaacaagttgaagtgaaagtgattaacgttgaaaaagacggtaaaatcggcttgtccattaaaaaagcaaaagatcgtcctcaacaacaacaatcaagaccgagcagaaatgatttccgtccgaaggaatcgtttgagcaaaaaatgaacaaattcttaaaagatagtgaagaccgcttaacatctttaaaacgtaacacggaatcaaaacgtgggggacgcggagcaagaagaggttaacttgttgctgctttctatatatctttcacaacaaagcacctgctgaccgcaggtgctttttatcttgatccatacgacattttttgagatttcgtcatttaatttaaaacttcctattgacggacaagcgattcctttgtattatagatcttgtgcttcttagcgcattttcattatggcggtgtagctcagctggctagagcgtacggttcatacccgtgaggtcgggggttcgatcccctccgccgctatccttttgattagaacataaaagcaaggcccgttggtcaagcggttaagacaccgccctttcacggcggtaacacgggttcgaatcccgtacgggtcatcttcgaaaacagccttccttaggaaagctgtttttttgtgtcttcgtaaaattctgatgaaagacatcgactttcatgaaagtatgcctctttgacgaataaagcgtcgaacgttttatggaaacgacaacttcttttgacaaaatttctttttcaccttcgctataatgacaagcaacgaatatcaggtgggggatgaaaagatggaaaaactagaaagaagaactgatttaacaggagcggggtttgaaagaatcagtacagggttaaaaaagatgaaaaacctgtttcttcatcatacgcattctctttttttctataaagggtttatttatgtcgttcttggttttttattaggacgagcctttatattatctgaaattatgccgtttgctctgcctttctttggctccatgctgcttatcaaaagagataagtccatgctcgcttgtctcgctttacttgctggagctatgacgatatcacctcaaaatgcattgtttgtgtttgcgtcgctgatcgtattccttctgatgtccaaggtggtttctttcatcatcaaagacccagtgaaaacattgccggttgtcattgtgctgtcaatgctgatcaccagaggagcatttgtttacctagagcaaggtgctgtgcaaagctacgattacgtcatggcgggtgtcgaagcaggacttgctttcattttgacactgattttccttcaaagcctgccgatttttacagtcagaaaaatcaaacactccttaaaggttgaagaaattatttgttttatgattttgattgcctcagttttaacaggtctggccgggatcacatttcaaggaatgcaggcagaacatattttgtcacgatatgtagtgctgagctttgcttttattggaggagcgagtattggttgtacagtgggtgtcgtcactggattaattcttggtctcgctaatatcggaaacctttatcagatgagtcttcttgccttttcaggtttattagggggattgctgaaagaggggaagaaagcaggagcagccattggcttaattgtgggttccttacttatttccttgtacggagaaggatcagcaggactcataaccacgctatatgaatcattgattgcggttgcgctcttcttgctcacgccacaatcagtgacctctaaggtagcgaaatatattcctggtacggtagagcatgtacaggaacagcagcaatacgcccggaaagtacgagatgtgacagcaaaaaaggtagaccaattttctaatgtatttcatgcgctgtctgagagttttgcgacattctacgaatccattcctgaagaaaagaaacaggaagaggatgtagatctttttttaagtacgatcacagaacgatcctgtcaaacgtgctataagaaaaataaatgctgggtgcagaactttgatacaacctatgaactgatgaaacaagttatgcatgaatctgatgaaaaaacctacgagcaaaaccgaaaattgaagaagaaatttagccagcactgctcaaaatcaaaacatgtcgaggaattgattgaagaggagatcgcttactataaagccaatcagaccctgaagaaaaaggtccaagacagcagacgactggtagctgaacaactgatgggcgtttcacaagtgatggaggatttttcccgggaaataaaacgggaaagagaacagcattttattcaagaagagcagatgatagaagcgcttcaacactttggaattgaaattcagcaagtagaaatttatagcttagagcaggggaatgtcgatattgaaatgagaatcccatattgccagggacatggtgaatgtgaaaaaatcatcgcccctatgctctcagatattttagaagaacagattttagtcaaagcagagcagtgtgcagagcacccaacaggctattgccacgttgtatttggttctgcaaaatcatatcgagtggctacaggcgtagcgcatgcagcaaaaggcggaggattagtgtctggagacagctacagtatgatggagctgggtgcgggcaaatatgccgcagctattagtgatggaatgggcaatggagcaagggctcattttgaaagcaatgaaacgattaagctgttagaaaaaatattggcatcaggtatcaatgaaaaagtagcgatcaaaaccattaatagtattttatctttacgaacgactgatgaaatctattcaacattagatttatccattattgatttacaggatgcgagctgtaagttcctcaagattggttcaacacccagctttattaaacggggtgatcaggtgatgaaggtacaagcaagcaacttaccgattggaattattgatgaatttgaagtggaggttgtgagtgaacagatgaaggcaggagatctgctgattatgatgagtgatggcattttcgaaggaccaaagcatattgaaaatcatgatctctgggtgaagcgcaaaatgaaaagctttaaaacagaagatccgcaagagattgctgatttattaatggaagaggtcattcgaacaagatcgggtcaaattgacgacgatatgacggttgttgtcatcaggcttgatcacaatactccaaaatgggcatccattccgacgggtacattctatcttgagaaacaagagatttcttgaaatatcgtataatatgaaattcttctggcgatgatggggatataaagcattcagttacgatcccaggaggaatgaagatgcgaaaaggtcacgtaaaccaaatcttattgattacagatggctgctcaaatcacggggaagatccacttgcgattgcctcattggcaaaggaacaagggattacagtcaatgtcattggcattatggaggaaaacagacacgatcatgaagcaatgaaagaagttgaggggattgctctagcaggcggaggcattcatcaagttgtctacgtccagcagttatctcaaacggtacaaatggtcacaaaaaaagcgatgacacaaaccttacaaggtgttgtgaataaagaattgcagcaaatacttggcaaagatactgaaatagaagagcttccgcctgataagcgcggggaagtgatggaagtagtcgatgagttaggagagacagttcaccttcaagtacttgtgcttgttgatacaagtgcaagtatgaaaccgaagctgccgaccgttaaagaagcactcattgatctttccattagtttaaattcaagaattggtgaaaatcagtttgggatgtgtatatttcccgggaaaaactcagatgctgaaattgtgttgaattggacgcctcgattcgattcactatcatctattttcccgaaactgaccacaggaggaatcactccaactggaccagcgcttcgagaagcgctccagcatttcaaatcagttcgttcgcgtaaagggctgcttgaagcaaaggaagagcatgatgaattcggcttctaacattccgttaggcacggtgattcaagggaaatggcatcaccatcattaccgcattgtaaaagagctaggaaaaggggcgaacggtattgtctatctagccgaatcgccaaatggtcaagtagcccttaaagtgagtgatgacagtatgctcattgcatctgaagtcaatgtattaaaatccttttctaaggctcctgtgaaaaccatggggccttctttttatgatatggatgatgcgatttatcccggcatgcttcaaaagcgttccttttatgtgatggagtatgtcagaggcccattactgctggaatttgtcaaacaaaaaggtgatgagtggatcgtcgttttaatggttcagcttttatctaatttggctcatttacatcaagaagggtggatatttggtgacttgaagccagataatctcatcgtgtcaggtcccccggccgcgattcggtgcattgatgtagggggaacgacaaaagcgggcagggcaatcaaggaatatacagagttttttgatcgaggctattggggattcggcacaagaaaggcagagccatcctatgatctatttgccttaagcatggtaatggtgaattgtgcgtataagaaagaattcaaaaaaggggcagaaccagaaaagcagctttacagagccattgaaggacatcctttattaaagcaatatgagagggtgttaaaggctgctctacaaggtaaatatcaatcagcggcggctatgaagagtgcgatgctgaaagaaggacagctgatcgcttcaagaaaagaaaagaagcaacagaaaaaaaacgggcaaaagcccgctgttcaacaaaatcaacatgtgacttcacgatcgagagttgcagcagcaaaaagaacacaagtacgcaaaaaatcgggtgggctttttgaaactattcttatcgtgtgcagtgtacttgctctttactgtgcatatgtagttttgttcctgctatagacctgtaaaaaagcaggcttcatctttgcttggagctactgaaagtgataggatatgtatatctttaaattacctgctctttgtgaggaggaagttgtgaatagaattgaatcatttttgaaaaaacatgatgtttaccttgaaaatacgacagtcattgtcggggtttctggcggaccagattccatgcttttactgcacgaactaaacaaacgtcgcaaagattcctttcagctgattgcagcccatgtagatcacatgttcagaggagaagaatcttttgctgatttggcatttgttgaggcatactgcaaggagcaagaaattccttttgaatcggcccgcatacaagttgcccaatatgcaaaagaaaaccacttaaacaaacaggcagctgcaagagagtgcagatatgctttctttcgtcaattgatggagcaatacaacgctcaatttatagcgcttgcacatcatggggacgaccaagtagaaacaatgatgatgaggcttgtgagagggacagttggaatagggctcgcaggtatccaagcaaaacgtccttatcaaggtggatggctgattcggccgctcattggatattccaaggatgacgtgctgaccgcttgtgaaaaagaacatatcccctatgtcattgatcaaagcaatcacacagatgactacttgagaaaccgggtaagaagacacattcttcccgtgttaaaagaagaggcacctcatgtacatgaaagctttcagtttgtaagtgatatgctgactgaagatgagcaatacttgcaggcattaacaaaggaacaaatgaaccaagtgataacgaatcaatcgcctaagcaaattaagatcaaaacgaagcctttgcttgacctgcctttgcctttacaaagaagaggcattcaactaatattaaactatctttatgaaaacactcaatcagcgttttcaaaccagcatattctagggactttggactggttatctcataccgaacaaccgtctggatcattagatttgccaaaaggtttacaagctgtcaagtcttatgattactgtatgtttacctttgaacgatcgcttgtactagaccagtcttatgctcttcacttaaagggcgaacttggagagaagcttttccttccaaatgggcagtctattgtggtatcaaatcatgttccggaggatgcacggaacggaaaccattttttcttgcttcaaaaagatcatgttcgtttccctttgatcattcgctcacgaaaaaatggtgatcgaattaaacttaaagggatgaatggatcaaaaaaggtgaaggatatatttattgataaaaaagtgcctcttgcagaaagagacagctggccgatcgtcactgactcggatcatcaaatcatctggatcccaggtctgaaaaaatccgtttttgaagaaattgatatgacaaacagcgatctcattgtattacaatatagacagcatgaaaatttgtagggggcaagcaaaagcatgaaacaagatattgaaaaggttttgatctcagaagaagagatccagcaaaaagtgaaggaactgggtgcaacattaaccagcgattatgatggtaaatttcccctggctattggtgttttgaaaggggctcttccatttatggcagacctgatcaaacacattgatacatatttagaacttgattttatggatgtatctagctacggaaaatctaccgtatcttcaggagaagtaaagatcattaaagatctagatacttctgttgaaggaagagatattttaattatggaagatatcatcgacagtgggttaactttgagctatctggtagagcttttccgataccgtaaagcaaactccataaaaattgtgacattgcttgataaaccaagcggtcgtaaagcagacatcaaagcagattatgttggatttgaagtgccagatgcatttgttgtcggctatggattggatttcgctgaacgttaccgaaacctcccgtatattggagtgttaaaaccatctgtttacgaaggctaatcagcatacgtatacatgaggttattggttgtattggaatgattttctatgatactattgaacatagttgtgcttactgtgggaggaggtaaggaatgaatcgggtttttcgtaatacgattttttatatacttattttattacttgtgataggggtagtcagttggttaggatcccctaatcaaaagcctgagaacatgtcttacagcaaattttcgcaaaatctaagtgcgggaaaagtggagagtatctccattcagcctgtaagaggggtttatgaaattcgtggtcaattagatggcgcgaagaaagatgaatacttcattacccatgttccagatggtcaaggtgttgaccagatttacagtgcactgaagaatacagatgtaaaagtagaacccgcacctgaaacaaatggatggctgcaagttttgacaaccatcattccgttcatcatcatctttatcctgttcttcttcttattgaaccaagctcagggcggtggaagccgtgttatgaactttggtaaaagtaaggcgaagctttacacagaagagaagaaacgtgtgaaatttaaagatgttgccggtgcagatgaagaaaagcaagagcttgtagaagtggttgaattcctgaaggatccacgtaaatttgcggagcttggcgcaagaattcctaaaggggttttactagtaggacctccaggtacaggtaaaacattacttgcgagagcatctgcaggagaagcaggcgttcctttcttcagcatcagtggttctgacttcgtcgagatgttcgtcggtgtcggtgcatcacgtgtacgtgatttattcgaaaatgcgaaaaagaatgcaccatgcttgatctttattgatgagattgatgcagtgggtcgtcagcgtggagccggtcttggcggtggtcatgacgagcgtgaacaaacgcttaaccagcttcttgttgaaatggatggttttagtgcgaacgaaggtattattatcatcgctgcgacgaaccgtgcagatatcctagatcctgcattgttgcgtccgggacgctttgaccgtcaaattacggttgaccgcccagatgtcattggccgtgaggaagtactgaaggttcatgcgaaaaacaaaccgcttgatgatacagtgaacttgaaagccattgcaagcagaacacctgggttctctggagcagatcttgagaacttactaaacgaagcagcacttgttgctgcccgtcataacaaaaagaaaattgatatgcgtgatatcgacgaagcgactgatcgtgtcatcgctgggccggcgaagaaaagccgcgtcatttcgaagaaagaacgtaatatcgtggcttaccatgaagcaggtcataccgtcattggtcttatcctagacgaagcggacatggtgcataaagtaacgatcgttcctcgtggtcaggcaggcggatatgcggtcatgcttccaagagaagaccgttatttccaaacgaagccagagcttcttgataaaattgtcggcttgctcggcggtcgtgttgcagaggaaattacgtttggtgaagtaagcacaggcgctcacaacgacttccagcgtgcaacaggcattgcaagaaaaatggttactgagttcggtatgtctgataagcttggtccgcttcagttcggtcaagcacaaggtggtcaagtgttcctaggccgtgattttaacaacgagccgaattatagtgaagccattgcttacgagattgaccaagaaattcagcgtttcatcaaggacagctacgaacgtgcgaaacaaattctcactgagaacaaagataagctagaaattatcgcacaagcccttctagaagttgaaacattagatgctgaacaaattaaatctctttacgaaactggaaagcttccagagcgtgtatacgcagatgacgaagagaagaatgatgatgtgaaagtgaacatcaagaaaaaagaagaagatgaggagatctaatctccctctgtgaaagctgccgggatcaccggcagctttttttatttcaattcctgaatggatcggtttcgaattgtttacaaatggaactcaattcgtgtatggtatgatagaaagtcgaaaaatgctctttttgagaaactattcaaagtggtgatgaagttgttactcgtgatagatgtagggaacacaaataccgttttaggtgtttatcataatggcgaactaaactaccattggcgaattgaaacaagccgtcataaaacagaagatgaatttggtatggccatcaggtctttatttgattatgtcgggctaatgtttgaccaaatagaaggaattatcatctcgtctgttgtcccgccaatgatgtttgcattagaaagaatgtgcgagaagtactttcacataactccccaaattgtagggcctggaatgaagactggattaaacattatgtgtgacaatccaaaggaagtcggggctgatcgaattgtgaatgcagtagcggcgattcacctttatggggcacctctcattgtcgtagatttcggtacagcgacaacctactgttatatcaatgaacaaaaacaatacatgggtggggcgattgcacctggtattaccatctcaacagaggctttatatacaagagcagcaaaactgccgagaattgaaattgtccgtccagaacacattgttggaaaaaacaccatcagtgcgatgcaatccggcatcctttatggatatgttgggcaagtcgagggaatagtgaaacggatgaagcagcaagcgaaacaaacaccgaaagtcattgcaacaggcggtttgtcgacattgattggaaatgaatcagattgcattgatattgtcgatccgttcttaacattaaaaggacttcaactcatttatgaacgtaatcgtgtcggtgtactataggaggttaaaaatcgaatggattacttagttaaagcgttagcatatgacggaaaagtccgagcatatgctgcaaacacaacagatacaatcaatgaagcacaaagaagacaccatacatggccaacagcatcagcagcgattggcagaactatgactgctacagtcatgatgggtgctatgctgaaaggcgaaaataagctaacggtcaaaattgaaggcggtggaccaatcggtgccatcattgctgatggaaacgcaaagggccaagtgcgcggatatgtctcaaacccacaagtccactttgacttaaatgaacatggcaagctggatgttagacgtgcagtcgggacatctggaacgttaagtgttgtgaaagatatcggactgaaagatcactttacaggacaaacggagatcgtctcaggtgaaattggagatgacttcacttattatcttgtctcttctgagcaagtgccttcctctgtaggtgtgggggttctcgtcaatccagataactcgattctcgcagctggcggtttcatcattcaattgctgcctggaacagaagatgctgtcattgaaagattagaaaagcggctctcaaccattgaacccatttctaaactcattgaaaaagggatgacaccagaagaaattttagaagaagtactcggagaaaaacctcaaattttagaaactgtacctgtcgaattttcttgtaactgctcaaaagaacgttttgctaatggcattatcagcctaggaaaagccgaaattgacgatatgattgaacaagaaggacaagcagaagctcaatgccatttttgtaacgaaacgtatgtatttacaaaagaagagctagaggagctacgtgaagaaataacccgctaagctctaagcagcgggttttctttttagaatggaaaggagacgaaagatgagactgaaagcaagagtggtatggacatttattctcgtgttgcttatgatcaatgccgttgtcattgcatatgtattaacaaagtcgcaaatgtcacaggcttcttcaaacgggaagagcggtgaagaaatcgcgtcgattggaaaagagaaggtgacacgtcaagaatggttaaagaagatggaagaccgctatggaaaggcaacacttgagcaaatgattaatcagaaggtggtcaatcagcttgcgaaagaaaacaagcttgaggtgtcctcaaaagaaatcaatcgtgaattgctgatgcttaaggcggtatctaataatttctacgaagatggacatacgagtgaaaaggactggacagaacagattcgttatcaaattttattagagcagcttttaacgagagatgctgtcgtttctgaaaaagaagcgaaatccttttatgaaaaaaacaaggacttatatcaatatgatgattcataccgtattcgtcatatcgtcgtgaagacaaaaggtgaagctgaaaatgttttgaaggatctgaaaggcggatctagcttcgaggcggtggcagctgaacgctccattgaccgctacacctctccatatggcggagatcttgggtttgtgacggaagaacaagaaagtatcccagccctatacatacaggaagctcaaaagcttcagccagatgaatggacaaaagaaccgatcgagaccaaaaacgggtatgccattattcaattgaaagaaaaattagatggccgctccttctcgtatgaagaagtcaaaaatcagatcaaaaggcagattgccatggaagatctaggtgaaaaggcgaatgtcaaaactctgtggaaagaagcaaaagtcacatggttttacgatggcgagcaggactaaaagcattgacaaaatttttcgaaattgataatttaatattaatacaataaaattactcggagatagaggtgttagtgatggctcgtattgcaaattcagtttttgaactaataggaaatacaccagtcgttaaattaaaccgtttagtagatgaagacagtgcggatgtctacttgaagcttgaatatatgaacccgggcagcagtgtgaaagatcgtattgcgttagcgatgatcgaagatgctgaagcgaaaggtactttaaaagccggcgacacgctcatcgaaccaacaagcggaaacacaggtatcggtctagcaatggtagcggcagcgaaaggaattaacgccattctagtgatgccagacacaatgagtcaggagcgccgtaaccttttacgtgcttatggtgcagagcttgtattaacaccaggtgcagaaggaatgaaaggtgccatcaaaaaggcagaagaattagcagaagagcacggttacttcatgcctcagcaatttagcaacgaagccaatgcggagattcaccgtcgtactacaggaaaagaaattcttgaacagtttgacggcgagcttgatgcatttattgcaggtgttggtacgggcggcacaattacgggtgctggcgaagtcctaaaagaagccatcccatcgattcagctttatgcggtagagccgacagattctcctgtattatcaggcggaaagccgggcccgcataaaatccaagggattggagcaggttttattccttccatcttaaacacggaagtatatgatggcattatccaagtgaaaaacgaagatgcatttgagcttgcaagaaaagcagcgaaagaggaaggaatccttggcggtatttcttcaggagcagctatttacgcagcacttcaaacagcgaaaaagcttggtaaagggaaaaaggttctcgcaatcatcccaagtaatggggagcgttacctcagcacacctctttatcagttcgattaaaccaattaccccagcatttgctggggtttttttatgaaatctgtagatggaaagcaaatactattttctaaataaattggattgcattacaataagattaatgaaaatgaaaaaggatgataacatgacacaacgcaggccgatgggcatcaaaattccttttacgaaagatgcattcttggaaagatacgaacaactaactgctggcgaaacacaccatgttctgcttgaaagtgctcgcggcggttcctacagcattgctggtattcacccaatcgctaaagcgaagggaaaagacgggatgacaaccatccattatcaagatgaggtgctgtttaaagaaggcgatccattcagagcgtttacggattggttccaaacccttcaaaccgaaacgaatgaggaataccctgattttcaaggcggggcgattggatttttaagctatgattatgctagatatattgagcattttaagatgctgtccattgatgacctgaaaacacctgatctttattttctcgtgtttaatgatgttgcagtctttgatcataaggaaaatatgttgtggctgattactcacacagagggagcggaacctgtgagtgtcactcatcaaagacttgaagatttgaagcaaaagtggacaagctctgtaatcgaatcagcacaatcacctgttaatgaaccttctgcagaatttgtaccagcagcaccttttactgaagagacctttggagaagcagtagagaagattaagcaatatatcgcaagcggtgatgtgttccaagtgaatttatccatcagacaagatgaacagctccacacccacccttatgatttatacaaaacgttacgtcaaatcaatccatctccttatatgtcttatttgcacacgcctgatttccaaattgtttgtggatctccagagctgctgattaagaaaaaggggactcaattagaaacaagaccgattgcgggtacaagatcaagaggcaaagacgatgctgaggatcaagcgctggcaaaagagctcattgaaaatgaaaaagagcgcgcggagcacgtgatgctcgtcgatcttgagcgaaatgatcttggacgcgtgtccacttatggctcagtaagagtgaacgaatttatggcgattgagaaatattcacatgtgatgcacattgtatccaacgtacaaggggaactgcgtgatgattatgatgcagtagatgtcatgagagccgtattcccaggcggcacaattacaggtgctccaaaggtgagaacaatggaaatcatagaagagcttgagccaacaaggcgtgggctttatactggatctataggctggtttggatttaatcaagatatgcattttaacatcgtcattcgtacggcgtactgcactgaaggcaaagcctttatgcagtcgggtgctgggatcgtcattgattctgtaccaaagcacgaatataaagaatcgattaaaaaagcctatgcagtaaaaaaagcattacagttgagcaaagaagagactattttgagttagaggtgagcagagcatgatagtaatgattgataattatgattcatttacgtacaacctggtccagtatttaggtgagcttggagaagaattgatcgtgaaacggaatgatcaagtaaccattcaagaaattgaagaactcaagccagattttctcatgatttctccagggccatgcagtcctgctgaagcgggaattagtatggaggcaatcaagcactttgcgggaagtattccgatcttcggtgtatgcctagggcatcaatccattgcgcaagtctttgggggggatgtcgttcgtgctgagcgcttaatgcatggtaaaacgtcagagattgaacatgacggaaaaggtgtcttcactggactccaaaatccgcttgtcgcaacgagatatcattcattaattgtcaaaaatgaaacgctgccggagtgctttgacgcaacagccagcacaaaggatggcgagctcatggctattcgccataaagagctgccaattgaaagtgtacagtttcatcctgaatcgattatgacgtccttcggaaaagaaatgcttaaaaatttcattgaaacctatcgtaaaaaggggcatgaagtaaacgcatgatcatttatctgaacggtcagtatatagaggagaaagacgcgactctttctccttttgatcatggttttctatatggcatcggtgtattcgaaacatttaccagcctggcaggacaagtctttctgttagattggcaccttgaaaggctcaatcaatcattgcgtgacctttgcatcgaatccacaatagagaaaccatttgtactcgacatcattcataccttactaaataaaaacgaaatagccggtggtcatgcgagaattcgattcaatgtttctgcgggcaggggcaatggattttctgcagatccttatgaagagtctgtcgtgtttgtcatgatttctccattccggcctgaatctgttttagatgagaaacagggagtcattcttcaaacgaggagaaatacgccggaaggtccgaggcgcctcaagtctcaccattatatgaacaacctgcttgcaaaaagagaagtgggaaatgacccgaagttagaaggtatctttttaacaaaagaaaatgatgtggcagaaggcattacctccaatgtattttggcgaaaaggcgatgtgatttatacaccgtcacttgatacaggcattttaaatggggtcactcgtcgatattgtatcgaaacactccaagcgatggaggcttcactaaaagtagggcgatacccagtctcccatttgctatcagctgatgaggcatggatgaccaattctgttcaaggggttgtgcctttcagaagtataggggaaatctcctttccccaaaacagccggatcttctcaacgaaattgagagcacaatatacaaaagaacgtctagattataaagagtaggtggacacaatgacacaacaagtgataaagcagcctaaagtcatacaagccaagcaccacacccttagttatgaagaaaagacattggtcatgggcattttaaatgtcacacctgactctttttcagatggaggaaagtttaatcaagtggataaagcgctggctcatgcagcacagctgatagaggacggggcacatatcattgatattggcggagaatcgactcgcccaggagcggcatttgtctcagaacaagaagagctttcaagagtcattcccgtcattgaaaagatcacgaaagaattggatgtaccgatttccattgatacgtataaagcccatgtggcagatgaagcagtgaaagccggagcttccatcattaatgatgtatggggagcgaaggcagatcctcaaatggcgcatgtggcagcgaagcacaatgtgccgattattttaatgcacaatcggccagagcgaaattacacacatttgatttcagatatgatcgcagatttgaaagaaagtgttcagattgcgaaacaagccggtgtccgtgatgacatgatcatattagacccaggtgtagggtttgcgaaaaataaagaggacaacctgatggtcatgaatgagctcgaacatttttgtcaccttgggtatccactgctcttagctacatctcgaaaacgattcatcggagctgtcttagacctgccaccggaagaacgtactgaaggaacgggggccacagtctgtcttgggattcaaaaaggcagtgcgatggttcgtgtacatgatgtaaaagaaatcgcaagaatggcaaaaatgatggatgccatgctgaataagggaggcgcttatcatcgataaagtatatgtaaatggaatggaattttacggctaccatggcgtatttgcagaagaaaataaattaggacagcggttccgtgtggatttaacagcttcacttgatttaagtaaagccggacaaactgatgacctcaatcagaccatcaattatgcggagctctaccaaatctgcaaaagcattgtagagggtgaaccagtcaacctcgttgaaacactgacagaaagaattgcgagccaagtgctaaaggattttccgacagttcaggaatgtacagtgaaggtaatcaaaccagatccgccaattccaggacactatcagtccgttgccattgaaatgacgagatcgcgcgcatgaacaataccgcatacattgctttaggttcgaacatagggaaaaaggaaatctatttaaaagaagctgtgaaaaaactgcacgaacatccagatgttcaagtagaatcgatctcatctatatatgaaacaacacctgtaggttacgaaaaccaagatgactttttaaatatggctgtgaaaatttccacctcgcttcgtccaaatgaattactggcacttactcagaaaatcgagcaagagttaggcagaacaagagaagtgagatggggaccgcgaacggctgaccttgacattttactttataatcgtgaaaatattgaaacagaacagcttgtagtgccgcatcctagaatgtacgaacgtttattcgttctcgttccgatgagtgagatttgcccagaaatcggcgaagtacaaataaatgccgtaacagaccaagaaggtgtaagcatatggaaaaagacatgtggggtagaagaattcgtgcataccgaaagctaaaagggtatactcaggaagggttcgcgaaaagactgggcatctctgtctctgtcttaggagaaattgagcgtggcaatcgattaccaacaaaccaattggttggtcaaatagcagatgctttaaatataacggtggaagaactttcgccaattcttgaagaaggaaggaggggaaatgatgtttaaaatcggagatatcgacattaaaaacaaagtggtgctcgcgcctatggctggtgtgtgcaactctgccttcagactgacagtgaaagagtttggagcaggtttagtctgcgctgaaatggtcagtgataaggcgatcctgatcaacaatgcaagaacaatgggtatgctatacattgatgaacgggaaaagcctttgagccttcagatatttggaggagaaaaagacactctcgttgaagcggcaaagtttgtagaccagaataccacagcggacattattgatatcaacatgggctgtcctgtgccgaagattacgaaatgtgatgcaggagcgaaatggctgcttgatccaaacaagatttatgaaatggtctctgctgttgtagatgctgtagataaacctgttacggtgaaaatgagaatgggctgggacgaagatcatatcttcgctatcgacaatgcccgtgctgttgaacgagcaggtggacaagcggttgcgcttcacggacggacacgtgtgcagatgtacgaaggaacagcgaattgggatattataaaagaggtcaaacaatctgtttccattccagtcatcggcaatggagatgtcaaaacccctcaggatgcaaaacgtatgcttgatgaaacgggtgcagatgctgtcatgatcggaagagccgcactaggaaacccatggatgatctaccgaacggttcattatttagaaacgggtgaattgaaagaagagccaaacgtacgtgagaagatgtcagtgtgcaagcttcacttagacagactcattgatctaaaaggcgagcatgtggctgtcagagaaatgagaaagcacgcagcatggtacttaaaaggtgtccgaggcaatgcggacgtgagaaatcaaatcaatcagagtgaaacgagagcggagcttgtacaagttcttgataactttacgatcgaagccgaggcaaaagagcttcaaagtataaaagcaggataagactatctttctttttgtagctcactgctagtgcatgtactggcagtttttctgcttttctctgcaaaatacattaatggagtgatataaatgagtaatgaagggcttaataacgaagaattaaatgaccaattccaggtcagacgtgacaaaatgaataaaatgagagaagagggtatcgatccattcggtgaacgatatgaccgttctcatcaatctgcccaaattattgctgaatacgatgagttttctaaagaagacttagaagaaaagtctgcccaagtgacaatcgctggacgtatgatgactaagcgcggaaaagggaaagctggctttgcgcatatacaagatttagaaggacaaattcaaatctacgttcgtaaagatagtgtaggagaagaagcttacgaattattcaaaagctcagacctaggcgatattatcggtgtaacaggaacagtatttaaaacgaatgtaggagaactttctattaaagcgactagctttgaggttctgacaaaagcacttcgcccgcttcctgataaatatcatggacttaaagatgttgaacaacgttatcgtcagcgttaccttgatctgattgtaaatccagaaagtaagcagacgttcatcatgcgaagcaagatcatccaatctatgagaagatacttagattctaaaggatacctagaagttgaaacaccaacaatgcacagcatccctggtggtgcatcagcacgtcctttcattactcatcataatgcactggatatgccgctttatatgcgtattgcgattgaactgcacttaaaacgcctcattgtcggtggcctagagaaagtatacgagattggccgtgtattccgtaacgaaggtgtatcaactcgccataacccagaattcactatgatcgagctttacgaagcttacgcagattataaagacatcatgaacctaaccgaaaacctgattgctcatattgccgaagaggtactaggaacaaccacgattcaatatggagaagatgaaattgacctcaagcctgaatggaagagactccatatggttgaagcggtcaaagaagcaactggtgtagacttctggcaggagatgtccgtagaagaagcgcaacagcatgcagctgatcacggaattgaaattacgaaaaacatgacagtaggtcatatcatcaatgagttcttcgagcaaaaagttgaggaaactttggtacagcctacatttatttacggacacccagtggagatttctccattagctaagaaaaatcctgaagaccctcgcttcacagatcgctttgagctatttatcgtacgccgtgaacatgctaatgcattcacagagctaaatgatccaatcgatcaaagagaacgtttcgaagctcaattaaaagaacgtgaagaaggaaatgacgaagcgcatctaatggatgatgattttgttgaagcattagaatatggtatgcctccaacaggcggacttggaatcggtatcgaccggataatcatgctattaacaaattctccatcaatcagagatgtactgcttttcccacaaatgagaaaccgctaatacgtcaattaaagcgccattataactatggcgctttttatttttcataaaatgaaactttttttaaaaaaactattgcaaggaaagaatcaaggtggtatattattattcgttgccgcaaaacagcagcgaggttaaaaaaagaaattgaaaaacttcttgactttaaccgacacaaaatgttaagatattaaagtcgcttaagagcgataacgaaaatgatctttgaaaactaaacaagacaaaacgtacctgttaattcgagtttttataaaaaaatcctatgaaatatcataggtagtcagtcaaacgatgacgaaaaacaaaatccagttgcaccagtaactccagtaggaccggtatctccagttgcgccagtggctccagttacaccagtggctccagtaggaccggtatcaccagttacaccagtggcaccagtaggtccggtatcaccagttgcgccagtagctccggtatcaccagttacaccagtaactccagtaggaccggtatctccagttgcgccagtggcaccagtaggtccggtatcaccggttgcaccagtggcaccagtaggtcccgttggacctgtatcaccagttacaccagtggctccagtaggaccggtatctccagttacaccagtggcaccagtaggtccggtatctccggttacaccagtaactccagtaggtcccgttggacctgtatcaccagttgcaccagtggctccagtaggaccggtatctccagttgccccagttgcgccagtggcaccagtaggaccggtatctccggttacaccagtatctccagtagcaccagtaactccagtaggacctgtatcaccagttgccccagtatcaccagtaggaccagtatctccagctgcaccagtggctccagtaggacctctttttacaatcttattatttgtttttttccgtccttttgctttagcacaagtgctgtgatgtttaacaacttttttctttttacattctcgtttaagaagagggcaatcatcaagtagaggtctatcgtgacgagattttctgtagtgaggttgccaatcatgcttttttccgcaaaagggacatttgttatcgtactgattatacaaattccccatctcctaaaagttaatattttattctatgtagaaatttaaaaagcggaattgagctaaatgatattttttagttcgaagttcatcgaatcaaatgatttaaaaattaaatcgttttatgttatggtgttgaaagtatgaaactagtatgatttttgacagaaatggggacatcatttatgagtcaatcagttttacaacacgcagcatattccgtgttaaatttatcctctgtaacagaaggtggcacaatcaaagagtcatttgaacatagtatggatttagcaaaaaaagctgagaagtggggctaccatagatattggcttgcggagcaccataatatggaaggggttgcgagctcagcaacgtctgtcttaattggacatattgctggagggactgaaaagatccgggttggttctggggggattatgcttccaaaccattcttcactcgtcattgcagaacaatttggaacactggagactttgtatccagggagaattgatttaggtctaggtagggcaccaggaacagatcagttaacagcaagggcacttagacgtaatcttcataatggggaggatttccctgaacagcttgaagaacttcggcaatatttcaaaccgaccggtcatgtcaaaaaacatgtaagagctgttccgggagaggggctagatattccgatttggcttcttggttcaagtggttttagtgcaaggcttgcaggagaacttgggctgccatttgcctttgcggcacatttctcacctaaaaataccattcctgcattagaattatacagacagtcatttcaaccttcagatgtgttaaaagaaccttatgcgatggttggtgtgacggtttttgctgctgatcatacagagagagctgagtatttggcgacgtctcattatcagcgatttttgagcctcattcgtaatacaccaggaaaacttaaagcccctgttgaaaatatggatgggctgtggagtccatatgagaaggcaatggtggacgaacaattaagttcgacgatgatcggggataaacaaaaggtgaaaaaagagttagcagcctttattgaggcgactcaagcagatgaagtcatgattaattctgatatgtttgaccatcaagaaagaatgcgttcttatgaaatcattgcagagatatttcaggaggaacaagaaaaataagaatttaaaaaagaactgcaaagagcagttcttttttatttatgctttagtaaacacgcgaaatggttgtcctactggcagtactgtacgaccgaaatgtgtattgagtacaacagctgcagaaccataaaatgaaagaagagaaataattaattctgcaataccagcaatcgtatgagttacatcatacatcacaccaaacgagctaagggaaaggccgatgaataagaaatcaataaagacgaaaatcaaaaacaatactttatgtgtttccattgcaccgatcgtcataaataagctgaaaatcaaataaccaataaaagcaaaacctagttgttttgggtccgcagcttccgcaagcgttttcccaaaaacgccagcttgaatgatccaagtcgttccaacgcccatccaaaaaagaccgaatgcgccgaaggcagtggctccaaaaatattatgatgctttgaatcttgtatggacgcgatgagttgcgcgattcctccaaggaagatagcccaaggtaaaataagggatgtgccatctgtgattcctagtttttgtgaagacgcaacaagcgtcaccattgctaaaccaaacaaaccaagtggtgttgggtctgcaattgataatcgaattgcttgaacattttgtttttccataatgacctcctacaatttgcacttacaaaagatactcgaattcgatagaaacgtcaagctcttttttagtagacacttgcaacgtcttccaaataaatctatatttaatacataatacatgtgatagaaaaagagggattagaatgagtaaaggcttagctggaaaaaccattgccatatgcggcacaagaaaaacagaagaaatgagtacacttgttgaaaagcaaggaggacaagctgttattcgttctcttcagggcactgtatttttagccaaagaggagttaaagccaggcatagaaacctttgtaaagaagggagctgactgggtgattttaacaacgggtattggtacagatacattaattgaaagtgcagaagaattgcaacttggagaagaatttatgaataatttatcaaatgctcatattgcttcaagaggatacaaaacgttcgcggctctaaaaaaacacggaattcagcccgatgtgtctgatgaagacggaaccgttcgtgaccttatttcaaagttagaagacaaagagctgcaaggtaaacgtgtcatggtgcagcttcacggcgaaaatgcaccagctctcatcgactttttacataagaagggagcagacgttttgcagctcatgccgtatcagcacacgccccctgaaccagaggcggctgacactttgcttcatgaaatgaaagaagggaaggtccatgccgtctgctttacaactgctgttcaggttcaatcctttttcaaactagcagaagaatggggcaaaaaagaagagctgcaacatctattcgagcagcatgtattagctgttgctgtcggaaaagtcacagctgaagctttaaaagaagagggagtcagccgaattcttgcccctgaatttgagagaatgggtgcaatgattatagaattatctcagtatatgaaaaaacaatcgacacactcatagaaaaaacgcctttcacatgatgagtgaaaggcgttttcgttagattgtccgttttcgattcgtgcgaatttttttcaaaacgaaatatagcacaatcaggacaatggcaatcgccataattggtgttgtatacgtatgagcgacactttgaatgtggccccattttgttccaagttgcataccgaggtaaataaaaaggatagaccaagggatggcggctaatccggtcaggagaacaaatttgagaaatggcatctttgcaataccagctggaatcgagatcgcatggcgcacgactgggataaaccgggctgtaaatacgacgcctgttccatatcggtcaaaccagcgttctgccgtggcaatatgatgctcatggatgaataaatacttcccatactttgttaaaaaaggtctgccgccgtaaaggccgatccagtaaataaagcactgggccagcgttcctccaatgaccccagcgatgacggctccaacaaaaccaatgcttcctgttgacaccatatatccgccgtaggcaagtacaatttcactcggaataatttcaatcatcagtccaagtgcaacacctgcgtaaccaaggcttgtcagccaggttaaaatttcattaaacaaggttcccattcatttcactctgcctttaaatacgaattttcttcaagcatccttataagagcctatgcttgttttgcttctctcatgagtatgctttgcatatatgctagcatggctggccgcatatcatgacgtatcaatccgatttcagccgttgccttaaatgaaccgagcttatcaccaacgtcaaatcttatcccatctagttgttttgcataaatgggtgattcatgtgcaatgattttcagcgcatctgtcagctggatttcgtttccggcacctctctcgattcctagtaatataggtgttaaaaggtccctgcccattatggctaaatcggaaggagcatcatgaatagctggcttttccactaagtctgtgacttcaaacactagaccgtctattctagctggtcttatcataccatatttgctgacatctagacgatccacttgctggacgccaatgacctctatttgtttgtcttcaaagacttccatgagctgagagagtgcgggtctttctgacaccataacatcatcacctaaaagaaccgcaaaaggatcgttgccagtaaaatgacgtgcacataataccgcatgcccaagacgaagagattgaatattggccatatccgcaatatgtttgatttcagccagctgttctttttccctttttcgagcaaatgatgttctagttcaatcgaacggtcaaagtgatcttcatgccaagaaaggggccaatcgctttacttaagaatcatgagaaacctgctagatgcatgacatataagacaatataggtgagaagagacgctgctccgttgactgcggctcattcgcacctgtcagttttcttttttacttggaacgtccaatttcgcactgtgcgagaaaagaggggacaaagcaggcagttaaaaaagaagaacagaaagtcaatcagcgtattgcttgcgcctacaatgaaaaatgcagtataggaccgaaagtttttctttgtcatgtgaaggatcatcacctcgtgatataatttgtaagatgaaacgaacggtggtgcacattcatgtatttaacaattggagaaacagctgaatacctagaagtatctgaagcatatgttgaaaaattaattcggcaaaaaaagattcgctacgtatttgacggggaatcatatctcatttatcaagggcagtttcaaacacatatgaaacagctagaacaatataaagagctcattcaagacatcttaaatgaaccgattcctgaggacccggacgtaaaagatgaagattaaaaaaagactgtatgagaagggagagccttttcatacagtcttttttattggctgacaccagtttggacaatgttcatatgacaattcacttgaacatctgcatcagggtagagtttttgccatttttctggtgtcatggctttatctttagagcgatatctcaaaccgagtccaagcggatcaattttttgatttttaaaggattgaacaagttctcttccttgctgagctacacgctcctcaacttctttttcgacatgctttaaaatagaaggcgtatcgatttttttcgatttcatgaattcttttaattcacctttcagtttgatatcaatggtgatatgaggcttttttgtaaggttttctgttggtttcatatgataagacacatgtgatttaatattttcaatgacgacatgtgttttctttttgtcattaaatcgaaactcataaatcccgtttatatgattttcaatcatcgctttaaacgtaaacgtatcttcccctggaatatgcccaaccattttttcttgatcaaaaagggcgacacctgacactttaatagagttgcttgtatttttaatgtaagggaggtaagcatcaacgccttttgccatcatctgattcataaaaatatgctgattggtgacaggttgattgccgtttcgcatgttttgggcgagcaaatctgaaagatatacacctatatttaagttggtttgattcatttttgtatgcaataaatcttcaacttctccgtctactatggcaaatacttgccttgacccaatgatcggatcacgatagatgtaattcatcaaatcaatcatacccacttctttcgccagcttttcacttattaaaatcacgagtacttgtcccatgacaacggggaaaggcgatttttctgaaacaagaaactgaatattactaatggtatttgacttagcacttacaatttgatagcttccttgctcttcgcttttaaaaacagggaaaacaaagaagcccttcatttctccatcttccaataagtcaaatcccgccgcctgcgagatacttaattcatctaagagacgaggctctgcacagctcgttaaaaaaagactaaataacatgagacacatcagaatagaatgtttcatgctcgttttttcacccacctttttttcagcagcagcccaatgatcatacatccaatcaatccatagatgaggatgtacccgctatattccacccatttattaaatgtctcaaaagaggtagctccgataaaaaatgaaaacatgccgagaatgagaaggctgagaacaattaacgtgatgcgctggctcgtctgaaacacttgttttgccattctgctggcggcccataatggaatggcgatatttggaacgatgagcaaaagccatagcgacacttcaataaattcaaagcgctggataaacggaagtttgacaatgctggtaaatgtcaatgtcggccatttcgttagtttgagctgagcacttgagtagtacgctatagaaacgagaaatacaagcaaattgaggcatgtggtcagcaatgcccccatatgtgcaaatttttgcgacgtttgtgcttttttaataaagggataatagacaagcagtgttccaaaaccaaacatggataaagaggcatctttgacccccaccatgagttgtgaaaatgaatgatcaaacattgggaacataaaccggatgtgactatatttcatgacataaaagcagataaaggtcatccagtacgttaggataatactaaagaatgcccaaccagcgattgttctaaatccgcccgtatgaatgtaatagacaaggatgagaagcactgatgcaaataagaggccgggaatttctttaaacagccaaacatggatcacatccatataatgaataagcacaatcaaagacaatgaagaaaaatacaaaatgtagagaatgttgatgaattgtccgagccatttaccaaacacagattgcgtaatgtcactaaattcgtcagtaggtgcttttttaaacaaaaagtaaataaggaaaatcattaaattgacacttgcaccagcaattaaaatggcaatccacccatcattattaatcgtccggacaagattcgtctggaaatttaaaataccaacacctacttgattggcattgacaagaaaaaatacaaaaaaaggggatacttgaaatttttcttttacagaagaagaactcatgccttcacttccttattcataaaaatcatttttccccttgcggccttgcttcggcttttggtggtgtatcgtttcatttggcgggcgtaagttctctgggcgtttattcaaaaatcggagctgaggtcgaatcaaactgccctttaaatcggccaatcgaagtggaaagataggttctaagtaaggacgaccaatagacgttaatttcattaagtgggtaagaagaaaagctcccatgagcgcaattccgagcgctccccacgcttgtgcggcaaaaagaaatgggaagcgtaagagacgaatggtcgtccccattttataaatcggtgtgacaaaagaggcaagagctgataatgcgacaataataagcagaatattacttgttaatcccgctgcaactgctgcctgtccgatcacaatacctccaacaatcccgagtgtctgtccgacttttgctggaaggcgagacccggcttccctaagcagctcaatggatatctctaaaaataatgcctcaataattggcggaaagggaacgagatagcgtgatgctacaatcgtttctaataagtccttaggaatcagttcataatgaaacgttaaaatggcaacatacaagggggttgcaaaaatagaaaatatcacagcaaaaatgcgtaacagtcgaaaggaggatgctgcgatccaagacatgttatagtcttccattgtagaaaaatactcgagtaatattgtaggtgcaagcagggtatgaggcgaaccgtcaaccataatggctatttttccttctgttaaacctgaagaaaccctgtctggcctttctgtatttaaaaataatggaaagattgtattggacacatcataaagcatttgcgcaagataatttgaatctagaatttggtcataatcaacatctttaatccgctgaagaacggtttcaatgttctgcgggttggcgatatcctctatgtatacaacggctactttcgtttgagaaagggttcccactgtgtgttcaactactttaaggccaggggttggcagtctgcgtctgagcaagtttaagtttgtatccagcccttccacaaaggcttcctgcgcactgataatcccgaattcaatctcaggttgactcacttgtctacctttcttttcttcaatcggtaaaaggagcgttttgccccagtctgtctcaattcgaacagcaatactgccacgatgaagagcttcttccactttttgaaggtcacttgtaatcacagcttgttcaattgggatgtgttctttcagctcttcaagagtgggtgtcaaatgcaattgttgaataaaaggcaagatttgttcatgaagtaaattgccattaattaaaggtcgaaaaaaagaaattcgataaagaaaacctccggagcttgataattcattaataaaatcagaggaacgagataatgcttcaaatactgaattcgggtctttctgatgaggtttatttttcttcagcacttgaaccatctcctttcgcgatttgcctctattatccaaccaatcgtctgaagatatgcataaaaaaagcgttcagcttcatgagctggacgctttttttccatattgaacggcttctaataaaaagtcagccagatgaattgctctcatgctgggcgtatgtcctgcctttttgacgcctgctgccatttgtaattgacaacctggattcgacgtaacaatggcagccgctgctgtgtggttggcttctgccattttatgatctaaaatctgcatcgacatatcgggctgcaagatattgtagattcctgctgatccacagcagcggccggcatctttcatttccttaaacgttactccttgaatggctttcatgagcaccctcggcgcttgttgtacattcataccatttcgtaaatgacaggaatcttgataggtgatcacttgcgctggcagcgcaagtggcatgctgcggtgaaactccagctccacaagaatgcttgatatatcggttattttctgtgagaaggctttacttcttttttggaaatctagatcatcctgaagcaaatggccgtaatcagttaaaaaggcaccacagccgcccgcattcatgataatagcatcggcatctgtatcctcgaatgcttcaatattccgcttggctaactgttttgcttggtctttttctccgctatgaccgtgaagcgctccgcagcatgtttgtatagcaggaacgacgacatcacagcctgctagctgcaaaagatgaatggtcgcttcgtttgtgcttgagaaaaccgtatccattaaacagccagtaaaaaacgccacccgtttttttgtcttaccaatggctttatattcattcaaacgttttttcttttgaggcggcacctttggaagcgcttgttccatcagctgtaaatgggagggaagcaccttcagtatgcgcgtcttgcgggcagccgtttgcagaccagatgtttgataaaatcgaagaaagctagcagcttgccgcatacgactttgtgaagggaagagacctttaaacacaactcgtctcatcaatttgacaggaagcgattgttttttgtgctgttgaataatgtctcttgcatcttctagcagctgtccatacttgacgccagaaggacaaacaggttcacatgcacggcagccgagacaaagattaagtgaatgttcaacatcttcatctggttcaatgacgccatctcttacagctttcattaatgcaattcggccccggggagagtgcgtttcttgttgtccagattcaatataggtagggcaggaagggaggcagaagccgcagcgcatgcaattaagcagctccttttcatccatttgctcctgaaactgctgctggatctctttttgcttagaagaagaactcatgagaccaccacccgctttcttgaggcttttccaaacactttatctgggttcatgatatttgccgggtcaagcgcctgtttgatcgctttcattgcagcgattccttcttttttgaccttcagctccaaataaggggctttcatgagaccaacgccatgttcgcctgtgatggtgccgccgagtgcaacggctttttcaaaaatggcctgaaaggcagcttctacacgtgtcatttcttctacatttcttgcatctgtagcacaagtggggtgtaaattcccatcacctgcatgaccaaaggtacaaatgttcacctcgtattctcgggcaatgtcttcaattgcacgaaccatattggcaatttcagaccggggaacggtcgcatcttctaaaatcgttgtagggcttaatcgagcgagagcagataaagcagagcgtctcgctgttaagagcgcacttgcctcatcttctgaatgtgcgatcttcacgcttttagccccgtgctgttcacaaacttctgctatcttttggatatcacgagaaacagcttcggggttgccgtcctgttcaattaataacacggcttgaacgtcagtaggcaggccaatgtttgcaaaatcttcaacgacttcaagggtcggctgatccataaattctaatgtggcaggaatgatacgctcagcaatgatggccgagacagaagtcgcagcttcttccaggctttcgtataaacaaagcatcgtttgtttcgtttctggaagcggcaggagcttcagcaccgcttctgtgacaatcccgagcgttccttctgaaccaacaaacaatcgagtcatatcatatccagcgacatcctttgcaagctttccgcctgttttgataatgtcaccatttggcagaaccacttcaagcccaaggacataatctcttgtcactccatactttaacccccgcaggccccctgagttttcgttaatattgccgcctaatgtggaaattttcatagagcttgggtcaggcgggtagaagagacctttttcctctacttgatgaatgaactcctgcgtaatcaagcccggctgcaccgttgcggttagattttcttcgtctatttctaaaagttggttcattctagtaaagagaatcaccaacccgccttgggtaggacatgttcctgcacaaagattcgtccctgaacctcttgggacgatcggcaccttgtgagtggcgcagagtttaacaatttgctgcacttcctccgccgtgcgaggtgacacgatggcatctggcatctgctgaaaatttggtgtcgcatcataagaataggcaagacgatctgccttgctgtcttggacatacgacgccccaacaatctcttttaattgatttgaaaattctgaatccagcatatacaatcactcccgctcatttaacgtctcgtttctaccagtataaaaaaagaaccgtcacatgcctatggacgattctacaaaatatcaggctgttttatagttttttttgtatcatgatctaaaaggagcaaggccaaataaaaaagcatcgcatcttgcatgcgctttggatcaagtgtcgttaaatcctgaatccgttttaatctgtaatgaagtgtattaatatggacatgcatggcttccgctgtatgtttcaaagagtaatctgaagctatgagtacccgcaatgttttcactagttcaggataggggaaaagggatgtaatcgttcgatcaagaaacgcatcttttgtttcctgactgatttcctccataaaaagttcaagtgtcaaatcttcatcaaacacaatcggtgtttcagcatgcgccaattttaaagcgcgaaaagcttgatgaaaagactgcttcatgacatgagaagctgctggttttcccgcgccaatgaaaaccctcgatggtgaaagcgctgcgagcgcagcatggatatggaacaggcgcttgtgccatgtagcacgaccatctggtgtggtttgcagcatgagcaaaaaacgggcatgcccccagcgcacaataatttcctgattggtcaggtgcaatttgtccttcatcagtttgtattgatcctgcttcataaacgattcatcttggcaatcaatgagtacaaccacacgctgcttgttgacatcaagaccaagctgctttgccttctcggtcatatcaacagctgtctctggcagatgaagccagtcgaacacaaaggcttcaagctgcctttcatctgtttccgtttcttgaaaaaattcatgctcttgaatgagcagctccgtcattttacgtaaaatgtcgccaaaaggggagacatgccttggatcgcctgtcattccaatcacaccaatgacttcttgcttaaaataaataggcagattgataccggctttaacgcctttcatatgcagcacatcatcctttgtgagaattcgtttctgcccttctaaggacgtgacatatgcgccttcatgaaattgaccaatgcgtgctggatctgttgcagcaataatggtaccgtttgtttgtgtgatgatgatttcttccgtcagtacctttttgacctcatctacgattttttctgccagtgtcattgtgagcaaaacggtcccctccgagatgtttctttttacactatcataccatcatatgctcaggcatatctttcttttcatatgttatgctaaaataaacaacgcataggaagtagatgaaaggagacacagtcatgtcactgcaaaatcgattacaagatttattgaaagaagggcaggcgctcacagactttgaatataacgaagccgcacgtcaaaattggccgctagaaggggcaaaaatgacagaagaagcacgctttgctgatgtttatatagaacgagtggacaaggaatcggaggaaatgattcaaacggaaaaagtgtcctttttgaatacccctcttacatatgtaaaaaaacaacaaaaagaattcatttatattgagtcgaagtggtttgaagtggtggaagtcgatggactggccattgaatgggatgaagtattccaaacgtatacagtattattcggattcaaacgtcagaaaaaagagacaggacagctaaaagacatattctctgccttacatggtgctcagctccaatttaatggtcaagacggcttatttgatgtgaatctgccccttcttgagcttgatgacatcgaggaagatacgcctcttattggtgtcatcacgtcaatgtaccgctttttattccgattgctgatgcagcttgaaaagaatgaatcaaaaaacggctcaaatccctgagccgttttttagagcaatccttttatgaattgagcctcacccatcccgaagctccaatcggcgtctccattttccacaatggagatcatcacatccgttttggcaaccccgcattctttttctacacgttctgcgatttgtgcataaaacttttccttttgctcttccgttcgctgtttactgacaacactaatgacaaccagatcctttgttctcgggtaaccaagcccagtgtcttcaatgatcatctcttcagcgcggtgttgatgtacaatttgatagcgatctcgttcaggtacaccaaaggcatccaccattgcgtcatggcaagtgtctagcagtttttttaaatcctctttagaacggccttctatcaggtcaaatcgtaacaatggcatcacgtctacctcccaatatgtgttaaatgtacggttataatgtagccaacacttcgctgtttcactcgtttgtgcataagaaaaaagccaaaacactgcggtttggctttttcgctttggactaaggcgtgacaaactttacatcatgctcttttccatattgaaggtaatcttcatttggctgctcgttggtcaccacgatgtcgatatcttttaagtcacaaaacgtggtcaaggcataatgatcaaacttactatcatcaactaataagaaggttttggcgtttttttcaacgagtgtctttttaatatcagtctcaagcggggaggaattcgtcacgccgtgatcaatggataaacctgttgacgcaataaatgctttattgacattgtatgcttttagacgctcaacactttgataaccaacgaaagaatttgtttttcgctctagtataccgccggtcgaaaagatggtgaggtgttcataaggcatagcctgtgtaatgaaatccacgttatttgtcacaacggtgatctgtttctccgtcaaataaggaagcatctccagcgtcgttgtaccagaatcaacaaaaatcatatcaccatgttcaacaaatgcggcggcagtctgtccgatgagttgttttttactcagctgacgagtctttcgctcctgatacaccactaatgtggagtgattcacagccacaccgccatagactttctttagcacgccggattctaccaatgcttgtacatctcggcgtattgtgttttttgagacgccaaaatgcgccacaagctcatcaagagaggcagattcccggtcaaatacatactcttttatttgctgaatacgttttgtttttatcatgctataatctccaatcaatacgaatatgctgattttattataacaataattccacgtaaaagatgtcacggatcaacatgggagaattgaatgatctttttctcttatcttttctcatttttcataagagcgtatgatagagaaaagaggacagaaaggattttcacttctatgaatcagcacaacatacagttttcaaagcttgcaaattttagagagatagggggactccaaacaaccgatcagatggtgattaaacaaggaatgttgtatcgatctgccgatttatcccgtctcactaaacaagacatattgaccttctcgacacttggaattcaaacgatttgtgacctgcgtacaagctcagaaagaagatcacacccgccaaagatcatggaacatgacaaaattgttcatatccctatgcagcctgacagcatgatgcctagcaaatgggccatgtttcgaatgctggtagcagaaggaaagtctctatcctttacgccgatcatgaaagatttatatcaaagcatgctcaatgagcgaaaagaagaaattcagcaattgtttacattactgtccgatgaaaaaaattatccgcttatgcttcactgtacaagcggaaaggaccgcacaggctttttatctgctcttatacaattagcagcaggtgtgccggtgtataccgttttaaatgaatacatgcgttccaacgaaggcgtgcgaatactagtgaaaaggcaagaacgatttgttcgcatgatgagtttataccgggtgtcaaaagaacaagttcaaccgctgcttggtgtgcagcaagattatcttgaggatgtactaaaagagatgatagatacatacggaagtgcagagcagtatttactagaagcctgcggggttcccaaagctcagctgatagaaatgaaaaacatcttgcttacaccatctgctggcattccatcacaaaacgcagaataaacttgatatgaggtgatgcaaaacatgttgaaaaagatgagtatgacagttctgacattggtttttatgtgtgtattcttattgattccttctagcagtctagctcgttcaatgccaaaagggaagcttgagagcacaagagagatgcgtgccgtgtgggtcgcatcagtgtataacctagattggccttcaaagaaagggctgtccgccgaagagcagaagcaagagttcattcaactgttagacgagatcaaggcgatgaatatgaatgccatcatcatgcaaattaaaccaacagcagatgccttttatccgtcgaaattcgggccttggtctgaatatttgactggtacgcaagggaaagaccctgggtatgacccgcttgaatttatggtagaagaagcacataaacgaggccttgaatttcatgcttggtttaacccttatcgaatcacaatgaatcataccgatctcaaccgattatcagccgatcatcctgcaagagcgcacccagattggacgatcgcctacggaaatcagctgtactttaatccaggcattcctgatgctcaggacttcattgttgacggcattgaggaagtggtgaaaaactacgatattgatgcggtgcatatggatgattatttttacccaaataaaatagcgggtgtgccatttccagatcaagaaacgtatgaaacatatgggaaaaaagcatttacacatatagaagattggcgaagagataatgtgaatcaattagtgaagcagattaatgacaccattaagaaagaaaagccatatgtgaaatttggtattagtccattcggggtatggcgtaatatcaaagacgacccgactggttcgagtacaacagcagggatgaccaattatgatgatttatatgctgatacaagagagtggatacagcagcaccatattgattatatcaccccgcaaatttattggagcatcggctttcagcccgctgcctatgatgtactgacgaaatggtggtcaaatgaggtgaaggggcagcctgttcacttatacattggtcaagcgacttataaaatcaatcaaaacagtgatcctgcttggtctgatcccgaagagtatttccgccagatcaagctgaacaggcagtcacagctcgtccagggaagcatgcattttagtctgaaggatatcaatcgaaatcccttgaatgtaaagaaacgattaatagaagaaacctatagcaaaccagccctcattccagagatgccatggcttcatcaaaaggctcctaaaaaaccaatcatccaatctgtgaaaaagacagagggtggcgcagttttacagattcaaaatgaccggagctctgccgcatcctattatgcagtctatcgattgtcaaataaagggacgtatgaatttgtgcaagcggccgtaaaagaaacaggctcctttacacatgtcaaagacctttcagcaaatcaaaagaagagctatacttacaaagtgacggctctcaatcgtcttcaccatgaaagtaagccttctacaaaaacaataaaataacatagtaaagcataaatggggattttcctcgatttatgcttttttgctttctctatttttctactattcttattttaattttctgaattcaatcaagcttggcatgaagcagctacttgattaataaatatgatagaaaagcgccaaagggggaagcacaatggattttgaattaacgaaagagcagcaaatgatccgtcagatggtcaaagaattcgcaaaaacagaaattgcaccacacgctcaaacgattgatgaacaggcgatttttccagagaaaacatttcagaaaatgggggagctcggttttatgggtataccctttccagagaaatatggaggatcgggaggagatacgatctcgtatgcactagcagtcgaggaaattggaaagcagtgtgcgagtacagggcttagttatgccgcagcggtttccttaggcgcaagtcccctttattacttcggtacggaagagcaaaagatggaccatcttgttccgttagcttctggaacagcactcggttccttcggattaacagagccaaacgccggatcagatgcaaaaggaacaaaaacaaaagccatcaaagacggacaagaatatgtgatcagcggggagaagtgctggatcacaaatgccaattttgccagaacaattattgtcaccgctgtgacggatcatgatgaaaacggacgtccgatcatctccgcttttattgtagagaaagggcaaaagggactttcaattacaaacccatatgacaaaatgggggttcgcggttcagatacggctgagatcatattagacgaagtgcgtgtaccggctcatcacatattaggagataagtcgaaaggattcaagcaatttttatatacattggacggcggacgaatttccattgctgccttatctgtcggaatcgcgcaagctgcacttgatgcttcactttcctatgcaaaagaaagaaagcaatttgggcagacgctctcatccttccaggccattcagtttaagctggcggatatggcgatgcaaatagagcttgcaagacaaatggtctggaaagctgcttggctgaaagatcaaggcaaaccatttacaaaagaagcggcctatgccaaactttttgcttcagaaatggcgactaaagcaagtcttgatgcggtccaaattcatggcggaacaggctatatgaaagaatgcggtgttgaacggctggtgagagatgccaagctgatggaaatcggagaaggaacctctgaaattcagcgtctcgtgatcgcaagacagctgttagcgtaataccttaatgaaaacgcttactattcatgagggaggaaagcaatgatgtcgatttacccgcaaacgatcggctccctattaagagagaaaaaagaacagcatccagcacatgaagccattgtttacccagaacgttctttacgttattcatatgaagcgttttatcacgaggtcaaggaaacaggtaaaggtctcatggcattagggattcaaaagggagatcatatcgccatcatggcaccaaatgtacctgaatggctcattctgcaattcgcctgcgcctccattggtgctgttcttgtcaccgtgaataccaattttcaatcacaggaactctcatatttactcaagcattctgacagtaaaatgttgtttattgttgacggatttaaagaaacgtcctatgtcaacatgcttgaagagctgattccagagcttcaaactgctcatcaagatgtaatcacctcctcatcattcccttatttgaaaagctgcgtctatattggtcagcatgtcccaaccggtatgcgcagctgggatagtatacaaattgcagcgaaaagaaccgaggatcatgagtgggagaagcgaatggatgagctcacgcctgatgacgtcattaatatgcaatatacctcaggcacaacaggctatccaaaaggagtgatgctcagtcatacgaatattgtctgtaatgccggtcaaatcgcagattgtatgaaattaacagagcaagaccgtatgtgtatccctgtgccattctttcattgctttggctccgttcttggtgtacttgcttgtctcacaaaagggggaacgatcatcccacttgaatcttttcatccagaacgagttctgcaaacagttgaaacagaaaaatgcactgtccttcacggtgtgccgaccatgttcatcgcagagctcgatcatccaaatttccactcttatgatctgtctacattacgaacgggaattatggccggttcactctgcccgtcccatgtaatgaaagcagtgattgaaaaaatgggacttagagaacttacaattgcctatggtcagaccgaaagctcacctgtcattacccaaacaagaaccgatgattcgtttgaacgacgagttcaaacggtcggacgtgcgcttcctcacattgaagtaaaaatcaccttgccaggaacgtcaaaagaagtgccaagaggacagcaaggggagctttgcacaagaggttaccatgtcatgaaaggctattataaaaacgaagaagcaacaaatgaagtcattgatgaggacggatggcttcatacaggggatttagctgagatggatcacgacggctatgtaaaaatcacaggccggctcaaagatatgatcatcagaggcggagagaatgtgtacccaaaagagattgaggatgtcctatacactcaccctgccattcttgacgcacaggtcgttggtattcctgacgagacatatggcgaggaagcagccgcattcattcggctgaaacaagggaagtcgatctcaattgagacattaacgagctattgtcagtcgcaaatggcacgctacaaaatcccgaaatattttttcattacagatgagtacccaatgactgcctcaggcaaaattcagaaatttcgcttgaaagagcaggcgcttgatctaataaaggagtgaaggcagcgatgtttgaacaagtattggtcgccaatcgaggcgaaattgcccgtagaattattcggacatgtaaacgactcggaataaaaactgttgctgtttattcagaggctgatcagcatgcacttcatgtgcaagaagcagacagtgcctattatatcggtggcgctagagtatctgaaagctatttaaacatggaagcaatcatcaccattgccaaacaaacaaatacagatgccatccacccaggttatggtcttttatcagagaatgcagcatttgctaagcgctgccaaagcgagggcattgtctttattggaccatctgcacaagtcattcagcagatggggaataaaattgaagcgagaaaaacgatggaacaagcgggcattccaatcgttccaggtgtttcagctccgcttcatgatgcagacgaaggggttagtaaagcacagtcactcggctatcccgttatgctaaaggcatcgagcggcggcggcgggattggtatgcagctcgtccgcaacgatgaagagctgtatagagcatttgaaggaaatcaaaaaagggcacaaagcttctttcatgacggtactttatacatggaaaaggtgattgaacacgcacggcacatagaaattcaagttctttttgattcgttcggtcacggcgttcacttatttgaaagagattgttcactccaaagaagacatcagaaaattattgaagaagcacctgccgtctgtcttgatgacaccgtgagacagcaaatggggcaaatggccatcaaagctgccaaagcgattgggtatgaaaatgcgggcacaattgaatgtttagtcgatcaaaaccagcaattttatttcttagaaatgaacacgagattgcaagtagaacaccctgtcacagaagaaattacaggtattgatcttgtcgaggagcagctgaaagttgcagcattagagcccctgtccttcagtcaggaggacattcatcaaatcgggcatgccattgaagtccgaatatacgctgaagaccctgtgacattttatccgtcaccaggtacgatcactcaactttctacacctgacgccccatatatccggcatgagtcaagcgtaacgagcggcagtgtcattaccccattttacgatccgatgattgcgaaaatgattgtgtacggtgatacacggaaccttgcaatagaacgattaaaaacggcattacacgcatatgaaatagaaggaatcaaaaccaatctgccgctcttaaaagaaatggccggatctactgcctttttacaggggagcattacaaccgattatctgatgaaaaaaagggaggaaaaccgttcatgaaaaccgtcacgatacaaatggctggaaacttatggaagcttcttgtgaaacagggcgatgaagtgcaaaaaggacaggaagtcgccatcttagaatcaatgaaaatggagattcccattgtcgcagaagaaagaggtgtaatcagtaaagtgtataaagcggaaggggaatttgttgacgagggtgaggtgctcttggagctgacagaatagggggaagcagcatgacattaccaaaaaacgtgctcattagagaggtcggcccgcgtgatggcctgcaaaatgaatctgtttggctggacacaatggagaagcgaacatggatccatttactcgaagaagcccgtcttccctatattgaggtcacctcatttgtccatccgaaatgggtaccatccttaaaagatgccaaagaattagctcaatcattaaacaaaaaagatgatatcacctatgccgcactcatcccaaatgaaaaaggattagctcatttttttgaagcaaaccttgaggtaggggctatgtttatctcagcgagtgagacacacaacaaaaagaatatgaatcgatctatacaagaaacactgcctgtgatgaaacaaatgacagccgatttaaaagcagaaggacggcaaactcgggcatatatttctaccgtgtttggctgtccttatgaaaaacaagtgccgatggaccaagtactgcgattaacggaacacttgctgtcctacggcattgatgaaatatcactcggagataccattggagaagcccatccgctgcaagtagaaagacgattagaccttttacttgaacgctttcctgctgataaaatcgctcttcattttcatgatacgaaaggaatgggccttgccaatatttatacggcattaaaagcaggcatcaccatttttgatgcctctagcggggggcttgggggctgtccttatgcacctggctctagcggaaacgtcgcgacagaagacgtggtgcacatgcttcacaaacttgggatcgatacaaatgtcgacctccctcgcttgatcaaagcggctgaatggattgaagcaaaagtggatcgaaccctgccaagtcactgtttacgcgcttttcagtctcacactacttgataaagggtgaatcacatgacatcattggtcgatttttcaatacaagatgatcacattggcatcatgaccttaaacagaccagcacaagccaatgctctatcagctgctatgctagaggaaatcaatcaaacgattcaagaaatcaaacatgatgaaaatatccgctgtttgctcattacaggagctggcgctaaagttttttgtgcaggagcagacttaaaagaacgacgattgatgacagaacaagaagccaaagcagctgtcttcatcattcagcaaacctttacagacattgaatccttgcctgtccctgtcattgccgctatgaacggacacgcacttggcggaggtcttgagctcgcgctcgcctgtgatctccgcatcgcaagagcgggtgcagcactcggcctgccggaaacaggactagctatcctgccaggagcagggggcacacaaagactcccgcgcctgatcggacccgggaaagcaaaagaaatgatctttacaggcagctctttacgagcagaagaagccgttcaaattgggctgattgaacgcatctctacagccgattcactgatgaatgatgccatctcactcgcaaaacaaatcaccaagaatgggccgattgctttaaaagaagcaaaacaagccattcaatccagccttgatcacaatttgcaaactggtctgatgaaagaatatgaagcctatatgaggcttattcatacagaagatcgactggaaggtctcaaggcttttcaagacaaacgaatgcctcattacagagggaagtagcaagaaaggggaatggttatgatcgaggaatatgaattaaagaaacatcgaattgaaaagggcggggcagaacgctatcatcaaaaaaacaaagaaaaaggaaaattatttgtccgtgatcggcttcatttgctcttagatgaggattctttcattgaagatgccatgtttgcagagtgcaaagatgaacacttaccagcagatggtgtcgtcacaggaaccgggcgtatgaatggcatgactgtttgcgtcatggcaaatgactctacggttaaagcaggatcgtggggcgtcaaaacagtagaaaaaatcattcgaattcaagaaacggccgagaagctcaattgtccgatgctgtatctagtcgattctgcgggtgcaagaatcaccgatcagatcgcaatgttcccaggcagaagaggagcagggcgtattttttataaccaagtcaagctgtctggacgtatcccgcaaatttgtttactcttcggtccatctgcagccggcggtgcatatattcctgctttttgtgacattgtcgtcatggtcgaaggaaatgcttccatgtatctaggttcaccacgaatggctgaaatggtgatcggtgaaaaagtatcacttgaggaaatgggcggtgcgaaaatgcattgcagcacgtctggatgcggagatattttagccaaaacggaggaagaggctattcaaattgcacgtgattatttaacctatatgcctgccaactatacagaaaaaccaaaaacgacagcagcaaaagcacctaaaccatctgaaaccaccatccaagacttaatcccaaaaggccagaataccccatttgatatgtatcaactcattgatttactcattgatgaagggtcattttttgaaatcaaaaagctgtttgccgcagagttaattaccggctttggcagaatgaacgggcagcctgtcggtctgattgccaatcagccaagggtaaaaggcggcgtcttattccacgactcagctgataaagccgccaagtttattcagttatgtgatgcctttcatatcccgctgctctttcttgcggacataccggggtttatgattgggacaaaagtagaacaagccggcattattcgtcatggagcgaaaatgatctcagctatgtcagaagcgaccgttccgaaaatatccgtcatcgtccgtaaagcatacggggcaggactatatgcaatggcaggcccagcatttgagccggactgctgccttgctcttccatcggcgcaaatagctgtgatgggtccagaagccgctgtaaatgccgtctacgcaaataaaattgcagaactcccacccgaagagagaacggcatttatacaagagaaacggaaggaataccaagaagatatgaatatctatgaacttgcctctgaaatgattgtcgatggcgtcatcccgtttgaccgtctaagaacggaactttgtcatcgattactagcttatacatcgaaagaaatgacatttactaaacgaaaacatccggtctatccggtctaaagggggcgtctttatgatcaacctgaaaccagaatggataccggaagaaaagcaggtccaaaaaacacgtttgcatcagtggatgaaatctcttggtttttctacgtaccactcattctatcaagccagtattgatcgcactgactggttttggagagaagccgaaaaggcggtcggcattcaatggaaaaagccatatgaagcagcattaggtcagcactcattcatgtggccgaaatggtatcagggcggcacattaaacatcaccgaaacggccgtggacaaatgggcagaaaaagaagagacgaagcatcgatccgccatcatttggagcaatgaagccggtgaagaaaaaaaatggtcatttcttgaacttcaagagaaagtgtgccgtcttgcagctggctttttgaaagaagggcttcgaaaaggggatgtagcgatcgtatatatgccgatgcttccagaaacggtcgctgtcatgcttgcctttgcaaagattggtgtcatttttagccccgtcttctcaggctatggaagtgagcctctcgctgtacgcattcgcgcgtcaggcgcatccattgtcgtcacagggaacgaaatgatgcgccgagggaagacgatcaacatgcgagaatgtgtcgctgatgccatcaacaaaacaacaacagtacaaaaagtgattgtgcacacttccgctaataccggatatcaagacgatgtccggttgaatgagttgttaaaagaacagccgatagccggcacgacctatgtgaataatgaagacccgcttatgatcttgtatacatcaggcacaactggtacgccaaagggagccgttcatacacacgcgggctttccgataaaagcggcttttgatgcgggtctatgtatggatgttgcaaaaggagaccggcttttttggctgactgatatgggctggatgatggggccattcctcgtctttggcggcttaatcaatggagctgccatcgttttatatgacggcgctcccgattatccagatgaacagcagctctggtcgttcattcatcagcagaaagtcactcattttggactttcacccacatttattcgttctgcgatgcagcaaacgattgatggggtcgaactgccgcatgtcaaagccattatttctactggagagccgtggaatgaaacgccgtggcaatggttatttaacaccattggtcaaaggaacattccgatcttaaattattcaggaggaacagaggtttctgggggtattgtaggcagtacgctgcttcgaccaatcaaaccgattctctttaatgcggcgatcttaggaatggcggcagatgtatacaatgaagctgggcaaagcgtgatgaatgaagtaggggagcttgtggtgaaaaagccatgggtcggcatgacatgtggtttttggaacgaaccggagcgttatgaagatacgtatttcaaacgatttgacggcgtatggacacacggagattgggtcatgcaaacagaggacggtgaattccacatcacaggaagatcggatgatgtcattaatacagcaggtaaacgcattgggccagctgaaattgaatccatccttgttagacatcctgccgtgcatgaggccgctgtgattgggataaaggatgaggtgaaaggggaggcgctcgtatgttttatcgtgaccagtccacatgcttttgaagaagcagccctcattcaagagctttcagcacatgttggttcacatgccggaaaagcgctcaagccaaaagaagttcatctcatttcagctttaccaaaaacaaggaatggaaaaattgttcgccgtttactaaaagcggcgtatgaagagcagacttcacccgacctttcttcattagacaatccagatgtatataaaagcctgaccgaatacttgaataagaaacagaaaaagtaaaaaagacaggaaggcccctgtctttttttattgcatatgaaaattcgtgccatctgttgtttctttgacaatacctgctcgaacgacaaaatcaccgaaatgttcttcgtcttctcgttcttttgcatagcggggaagaagagagccaagttcgtttaaaatgtcttcctcaccaacattttcacggtataacttacttaatctgctgccatcaaacgcagcgccaagatacatgttgtatttgccaggtgatttcccgataaagccaatttcacctagcgcatgacgggcacatccatttggacaaccagtcatacgaatcgtgatttctttatcacttaagccgttttcttcgacaatctcttcaattttgtcaatcaagcgtggaaggtagcgctctgcttctgccattgctaagccgcatgttggcaaagaaacacaagccattgagctgcggcgcagggcggagtgttgctggccgtctgataaaccaaacttctgaatcagctgttcgatttgtttctttttatgagttgtgacattcccaatgattaaattctgattggcggttaaacggaagtcacccgtatgcaccttggcaatttcacggatgcctgtcatcagtggataatcatcataatctgtgatgcgtccgccttccacaaacatcgtataatgccatctgccattaatgccttttacccagccataacggtcaccgttatgatcaaagtgataatcctttgcctctaacagggtaaacccaaggcggcgctcaagctcttcttttacattttcaagaccaagacggtccaccgtatatttaaagcgggcattttttcgcacggaacggtttccgtagtcacgctgaatggtaatcacttgtttcgcaatctctacaacctgttccggtgtacaaaagccaatcacttttgcaagctgaggataggtcgctgtatcaccatgagtcatacccattccgccgccaattgcgacattaaagccaatcaattgctcattttcgatgatggcaataaagcctaaatcctgcgaaaagacatcaatatcgttagcaggagggaccgccacaccaattttgaatttccttggcaaataaagcggaccatacatcggttcaacttccgtatctggcgttgccgcaaccttttcctcatcaagccaaatttcgtgataagctcttgtttgcgggagcaggtcatcacttaattttttcgccagctcgtatacatcatggtgcacttctgattgataggggtttgatgtacacatgacattccggttcacgtcgccgcaagcagcaattgtatcaagcatagtagaatgaatgtcttgaatggtttttttcatattccattttaaaataccgtgaagctgaaaggtttcacgagtagtcagctttaacgtaccgtttccgtatttgtgagcaagctcatccatcacaagccactgcttagatgtggcgattccgccaggcaggcgtacgcgcagcataaattgataggctggctcaagtttttgtttctgccgttcatttctgaggtcccgatcatcctgtaaataactgccgtgatgtttcatcagacggttgtcatcatcaggaattcccgctgaaatcggatcaagcattacttcttttaacgtaccccgtaaataatcacttttttctttgatttcttctacgtcgctcggaggtccatccggcgctgttaatgctgtcttcaccatgtaagtaaaagctcctttctttcaagcatcaagtccattaatatacgtcgcgctgatagcgtttttgctgctgcaagttagctagatagctttctgctttctctttgctcatcgcaccttcttcttggataatcgatagaagggtatgatgaacatcatgcgccatatacttttcatctccgcaaacatatacataggcaccttgctccagccattcgaataattctttactttgcttcttcatttgatgctgaacatatactttttcctctgaatctcttgaaaaagccacatccattttcgttaagacgccatcttttagccacttttgccattcggtttgatataagaaatccgtcacaaagtgctggtcaccgaagaataaccacgattttccgcttgcaccgatttcttctcgttcctgcataaacgaacggaaaggggcaatacctgtgcctggtcccaccataatgatcggtgcatcagggttttcaggaagcttaaagttttgattgtgctgaatataaacaggcagcgtatcacctggttgtaagcgctctgcacatagaatggagcagacaccttgacgttctctcccgtgcgcatcatatctcacagcaccgatcgtcaaatgaacttcttcttcattcgctttcaggctgcttgcaattgaataaaggcgagccggaatttttcttaaaatcgcagtgaagtctgcggctgttccttcaaaaggaccgaaatcgcgcgcagcatcaactaaatctcttcgtgctatatatgcttttaatttttcttcatttccttcttttaaaagggcatggagggcttcatttttcgtcaagtccgccaacttttgaagaaggggttttgttaaaactgtaatttcaaaatgtgaggtaagtgcttcttttaaaggaagagtctcaccgtttttatgaacagttacggcttcttctgcattccatccgcatgtcgtaatcagttcatcaacaagcgcaggatcatttgttggataaattccaaggctgtcacccggttcataaacaagtcctgacccttcaagtgaaagctccaaatggcgggtttctttgttagagccacggccgtttagattgatattttcaagaacttccgcataaaaaggattcgttcttgagtattcagtagctgctgtttggctgtttggtcctgctgattcttgcgtgaaagctgcggcttcaccttcgctaagtgacgatgtcaccccttgaagccattcagaaaacggctcatcataatcaaggtcacaatccactcgatctgtcaggcgcgttccgccaagttctttgaagcgctcatcaaattcttttccagtctgacagaagaattcataggagctgtcaccgagcgatagaacagaaaagcttaaatgatcgagctttggcgcacgtctaccatggacatattcatggaaagaaagggcattgtcaggcggatctccctcgccatgtgtgctgacgatcatcagtaaattgtgtatttttttcagattatttggtttaaaatctgacatagaagagagcgtcacttgaaagcctttctcttcaagatgctgtgctgtctttttcgctaacccttcggaattgcctgtttgcgacccgtaaagtacggtcacatctttactgacaggctgcgcaggtgctgcggcagaaggagatagggcttgagtagctgtttctgatccggctagcgcagcttgtgctgataaataaccggtaagccaaattttttgttgatctgttaaagtcggaagcagctgattgagtagctctgcctgctgctgactaaaaggactgttcaatacatgaagttgcaacgatatccacctcacaaggaatataaacatagattaattcgataggaattatatatataggttcaatttgaactttaccgaaagtttgccattaagtaaaatatataatattgattgtcatgattaagatttctaatgacaaagcatatgcgaataggggaaaagacataaaaaaaggaaaacggtcatccgttttcctcttatctatctaatttacgccgttggaagtcccatcacagctttcacttctaaatattcctcgatgccgaagtctccccattctcttccgatacctgattgcttaaagccgccaaatggggcaaaataatctgtttcggcattgttaatggtgatttgaccagcgcgaatatgctcagcgacatattttaatgttttttcatcttttccaacaacatacccggcaaggccatacactgtatcattggcgatctcaagggcatgatcaagattctgatacgtaatgacactcatgaccggtccaaagatttcttcttgtgcaatggtcatgtcatttttcacattggtgaaaatggtatgtttggcgaaatatcctttatcgattccgtccggctttccagctcccccagcaagaagggtagcaccttcttcgattcctttttcaatataagattgcacggtatcccactgctttttagatacaagcggccctgtagcatgatcttctcttggatcaccaactgtaaacttcggcagggcattcagcagcgctttttcaaacttgtctttcattgattctggtacaagcacacgcgtagctgcagaacacacttgccctgtattcatcgcaatatgctgaatggcagtttcagcagccacatccacatctgcatcatccaagacgataagaggggatttcccgccaagctcaagagcgactttcttcacattgtccgctgcgttttccataattttagtgccaacagcacctgatccagtaaatgaaacaaagtcaatatcaggatgtgagctaatgccgtcaccaattacgtcacccgttccgtttactaagttgaaaactcctttcggtacgcctgcttcatcaataatttctgcaagaatcatcgcagcaaatggtgtaatttccgctggctttaagacaactggtgagcctgccgcaatggcacctgcgattttaagagatgtttgattcgttgggaagttccacggtgttatcaatccgctgacgccaattgcttcttttataatggtatgtccgccgcggtcctctgtaaatgtataagatttaagggcttccgctgctttagaaaaatgttcatagcccattttgtaatgaacttcttcggatactttcagcggtgcaccgagctcttgtgtcatcacttctacaagttcatctttgcgtttttcgtagccgcgcacaatgttttccagcatctttactcgttcatttcgagatgttttagagaaagaagggaaggcggcacgagctgctttcactgccttatctaaatcttcttttgttcctaagctaatggtgccaatgacttcctctgtcgcagggttgatgacctctgtcgtttcgcttcctgttgatgcaacccattctccgttaataaaatgcttctcttgatttctcattctgacatgtctcctttttatatgtgattcattcaatattctgttttcagctgatataaaactgtacccactgtgaaaaatctaaaacgaacaaactgcaaaagaaaaagtttctgatataatacgcaaagtgggacatatgtccttttcaaccggcgggcatgtatcatttaatggaactagactgaaaaaagaaggagcttttgaacgaatgaaaggtgttatttacgctttattaggaggcgcttgtattacactacaaggcgtagccaatgcaagaatcagccaggatattggtacatggcaggcagccaccatcacacagctgaccggctttatcatctcactcgtcattttactcgtcgtacgagacgggcacttcagggaatatcaaaaggtgcagccactttatttaataggaggcgcatttgcagcgattattatttttaatgaagtcaccgcgatccaaatcatcggtgtgacactcactatcgcagcgttactgattgcacagcttgcttttacctttgcaatcgatgcaaaaggatggtttggtgttcagaaaaagaaaatgaaatggcctcattacgcaggaattttattgatggtcacaggggtgatcattttaaaactataaaggagggcgtcagatggaggagcttcatgatgaatctctttttacctcatatatgaaggcacatcaattagaaagtgtctttcatcaaaagctcatatcacacgtaagtttgtggcgctatgagcaaggggagctcgtttgttcaaaaggggataagagggagtacctgtacttgttagtgaaagggaaattaaagattttcacgaccacaaaggaagggaaaacctttattcttagctttaaacatccccttgaagcgattggagatatcgaatacgttcagcagacggatatggtcaatacagtcgaagcggtcacagaagtacatatgttaagggtttctcatcaagcgctcatgcgtcatgcgaaggatgacccacgcatgttaacctttctgctaaaagggatcacaaacaaattttatacaaaatcaaacgatttgagtttccacctgttatatcctgtagaggtcaggcttgcaagctacttattgtctgttgtcacagatgatgacagcgcaagcgcccttcgtctcactgatgcggcaagcttaatcggtacaagctaccgtcacattaaccgagtcattcagcgattctgtgaaaaaggactgatagaaagacagagaggaaaaattacgatttgtgaccgcaaagggctcctagaaatagcagagcacaacatttatgaatagaggaaatgaagggatttatatatgatcataggaatagtattagccatcacggctggcgcactcgtcagcttacaaaccatttttaacagtaaggtcaatgagcagacaggctcttggtcaactaccaccctcgttcttggaatgggctttattgcttcactcctgatggggctcttactagagggaactggcatgtttcgattaagacatatggaagcgtggtactggatcagcggggctattggtgtaggagtggtcatttgtcttgttcaaagtatcaaacggcttggaccgacttatggcatttcgattgtcctcacgtcacagcttggctgcgctcttttgtttgattcgcttggctggcttggcttagaaaaagtagaattctctttgacaaaacttttaggtgttattgtaattgtggcagggatcttggtgtttaaattgaccaaattggagtctgcagaaaaagatcaaacgcaagaaaaagggctgccacaagagtagctgccctactttatatcaatcgacgccataaaactgttatcgcggataatccgtttaaaaggagccttttcatcaaaggcttttttttctgtccataagcgctcgtctggtagacagttcgatctttagcaacgagataactgtaggcgatttttcgttcaattgcttgcgtaagtgataacgcaaacggggcactgtcaatgaccaaaatggactctgtgtttaaaaaactagacctcgcatctaagttatatgtcccaataatactcaggtaatcatcaatcaccattgatttcgcatgaatcgaatatggaccttcgtattcatacaaatgaacgcctgttttcatcaattccttttttgtacttaaatatccagcaaaggctaatggatttggcgtcgccgtaagagaattcgtcaccactgtcgtctgaatctcactaggtaagggggtgagtccggatttcattgggcgtgttggaatgacataaggcgtctgtataagcacagaacgctttgcccggtgcgcaagatcgttcagttttttcagcacaagtggccgcttattaaaacgttccacaggatttgtgaaaaaggcaacctgtttcacagaagtggaatctgctgcccaatcaaatgaggacatcacaaaaggttctttcgtgcgcactgcatcatgataagatctgagcagctgttttcttagctttaacccttttttcgcttttggcttagagaacacagcttttgttctttttgtgaaatcatgattccaaagataaacgaaatattgctccatttcatctaatacttttccctttttgggattatagagcagcacatcacggtcaaaagcaaagtctttcggcggctggtctgcaaagtatttatcaccgatatttcttccgcccatcacagccactcggccatctgctagtagcagcttatcgtgtagccgattatgccacgtccatggcttgaacaaacgaaagggctcataaaaacgaatcgacatgtttggatgatttgctacagcatagcgcaaatgctttagcggaccgcgcaaactgtgacagatgccatctaacaacagctgcactttcacacctcgatcagctgcttcaattaaagcacctagtatccattcggctgtttttcccttttgaatggaatagtaactgagacggatcatcttctttgcctcacgaatcatttggatcctcacctgaccagattcaaagccgtcgtcaagaagcatgacttgatttgtcccctgatcgtctcctgagatagaagaggctttataaatgcaatgttctttgcatgtttttcgaacaggtaaataaaacaaaacaaatgcggtcaaaaatacatagacgacataaacaaggatgagataaaacaaaagatgaagcattatgatcagctcctttcacacagacacaacttttccttagtgtatgtcaaaaatgaaatttcactcatgttggctttcaacaaaatatatgacaaaagaatcagcttgtttttattgggcatttaattatagtatgaaatgagtaagggggaatcaaattgaatgaaccactatttaacattccaaccgaagtgtatcaaacgttaagtgaaacagaacgttatttactcaactatattcaccagcatttagaggatatctccaccttatccatcgtcacattaagtgaaagagccaatgtgtcgacagccacaattgtcaggctgatgaaaaaaatcggctacaacggctatacatcctttaaatatcgattgaaacaagaaaagaaaatgaccgatgcaagtgatcagctcaaaaacattgatgaagacatcaaactagcgattcggaaaaacgaagaagaggttttaaagacgatccagctgcaaagtattgggcaaattgaagatgccgttcaaaaaatacataatgcggacaaaatttatattttcggcagaggcttttcagagatgattgccaaagaaatgaccatcaaattacagctcatcggaaaaacatgtgaagtacatgacgacccgaatatcattcggctgaagtcgcgggatatcggtaaaaacgaacttgcaatctttgtttcattgaatggcgaaacagcagagctcgttgaagcgtgtcaaaatcttagcatgaagcaagtcacgacgattaccgtcacaacgagaatagattctacattaagtaaaatatcagatatgactctagtcggatataaaggcgaacaatccttcttcccagattatgaggtcagatcgcgcttgtctcttcatgtcatcgcccgcattttactagatgcctatgtgattcgaatgaaataatcaataaagaagccttcgagactttgatctagaaggctttttaacatgaaaacctttacacaatctgaaaacattttcactcctgcgtatgagatactttctttagagaaaagaaagaaggtgaaaccaattgatttatacctgcaccttaaatcctgctattgacctatatattgcattaaaagaaatgaaggcaaatgcagtcaaccgcacggaagatgaagattatcagccaaatggcaagggagtcaatgtctccattatgttaaagaaatatggattcaccagcactgcattaggatttattgctgggttttcaggctcttatattgaacaatccttaaaggacctttccattcaaaccgattttatctcagttgaaggaattacacgcattaatgtttttattaatacgactgaagaatacaagctcgtgaaccagggacctgcgattgaagaaaaagcgcttcacgcctttcgtgaaaaaatagcggccatcccgcagggggacatcctgatcatgtcaggcagcctgccaaagggcgtaccagccagcattttttcagaagtagcagctatttgtcatcagaacaacgtcaagtttattttagacacaagttccgcagcagttcttgagacacttcaatataagccgtatttattaaaaccgaatgaagaagaaatcgctgcttttttcggcaaaacacatcctatgtcagaaaaagaactcattcaatcaggagaaaagctcattgagatgggtgcagagcaagtgcttatttcccgcgggggagaaggggctttgttcattacaaaagacgccgtcttaaaaggaaacgcaccgactggcactgtggtaaacacagcttgctctggagatgcgatgctcgcagcctttcttagtaaacagcttgaaggtcattcacctgaagaatgcttacgttacggcattgcaacaggcgcatctactgcattttctaaaggcttaagtgatttacatgacattcattcattaattgatcaagtacacattgacaagatataagggggaatacacatgagccgtaaaaaaattgtcgctgcaactggctgtccaacaggcattgcacatacatttatggcagctgaggcattaaaaatagctgctgagcaactaggggtcgacatcaaagttgaaacgcacggtcaagtaggaattgaaaacgctttaaccgatcaagacattttggaggccgatggagtcattgtcgcagctgacaaagatgtgaatacagatcgttttcacggcaaaccactgattgaagtgcctgtagcgaagggtatccgcacgccaaatgaactgattcaaggcattatgaatggagaagcacctgttcatcaagtgaaaggaagaacttctggaacagaaaaaacatctgctccttcaccagctcaacaaaagtcggcgaataagtggatacacaccatctacaaacatttaatgaacggtgtatcacacatgcttccatttgttgttggaggcggggtcttaattgctttatcttttctattcggtatttactcagctgatcctcagcatgaaacgtatcatccgtttgctgcctacttgaaaaacattggcggactcggctttagcttaatggtgcctattttagcagcatttatcgctgattcaatcgcgaaacgcccagggatggttgtcggatttatcggcggcctgcttgcaaacgatggaggcgccggattcttaggtggtattatcgcaggttttgcagcagggtatatcatcgtactccttcaattcctgcttcaaaaattacctgcatcacttgacggattaaaatcaatcttcatctatcctgtcatcggtattttcttaattggggctgtgatgacaccactattagttccaatcacaggtctaaataattcattaatggattttctctcagctgttcaatccacgaatccgctgctcttaggtttaattgttggagcgatgtgtggatttgatatgggaggaccttttaacaaagcagcctatgtcacaggaacggctttacttgcagaaggtaacctttacttcatggcaggtgtgtcagcagcatgtatcacaccaccgcttatcattgcgattgccacaacgattttccgaaaacatttcacaccgcaggaacgaaatgcaggggccatcaactatattctaggagcgacacatataacagaaggggccatcccatttgcggctaaaaacccgatcgttgtcctgccaattatcatgtttggctccgccatctctgctatattgacgtatctctttggcgtacaggttccagctccgcatggtggattccttgtccttccagtcgtcacaggtgcattccagtgggtactatccatactgatcggatcacttgtaggtgccattctatacggactgtatcgtaaaaaaatagacaaacccgcagtttaatagggaggaagagaaataatggaacatatttatatgaatcttcatgaaaccgcgtcgtcacaggctggcgttttcgcagctattgctgatattgcctacaaagcaggtatttgtacatcaccagaggatgtgaaaaaaggcttagctgaaagagaagcactgagcacaactggatttcaagatggatttgccattccgcatacacaaacagacgccatcacaaaaccagcactcgtgatcgtccgcacagaaacaggcattgaatgggacgcttttgatgggaaaccttgctttttcttcttatccttactgatccccaaaagtgaagcagggaccactcatctaaaggcactttctgccctttctcgaggattaatggatgaagcgaaacgacaaaagctgctggaaacaagaacaaatgaagacatgctgactgtattagaaacagatattttaacgagagaggatgtttgatcatgcctttactatccacaacaccgatgcttgagactgcgaaaaaagaaaaatacggaatcgttgcattcaatgtacattcctttgacagtatttattgggtgctcgaaacggcggcagaattaaaatcacctgtcattttgcaaacaacggttggaaccgttcaatctcttggagcaaaagcgattgcagatacagtcaaagcggcggctgatcaatatcaaatcccgatcggtctgcacctcgatcactgtacggactttgatgtgattctcacctgtattcgtgcgggatatacatccgtcatgatcgatgcatcgatgcattcatatgaagaaaatgttcgccgcacaaaagaagtggtggacctcgcattaaaagtaggggtgaacgttgaagctgaactaggcaaggtgggcggcgtagaggatgatatcgttgttgatgaaaaggatgctgaaaaagccattccatcagaatgccgtcaatttgtagaagaaactggggtaccaactttagcacctgcaattggtaccgcacacggcatttataaaggggtaccggatattgactttgaccgtattgaacaaattgcatcgctggtcgatgttccccttgtgctgcacggtggttccgctgttccggatggagacgtcagacgatgtgtggcacttggtatggcaaaggtcaatgtctcaactgaattaaaaaatgcgtactctgaagccattcgtgatcatttctcaaacgaaccggaaagcttagatccacggatgtatttacaaaaagcgaaacaagccgcaaaagatatggtcacatcgaaaatacgtatcgttggcagtgagggcaaagcccatcctctatatcagtgaaacaaaaaagcagagccgcttaagctctgctttttcacattattcgttttctttcatttcatttgatgtgcgtacacgtgcatttcccatgaacaggaccgtaatcgctgcaagagcaataggaaacaacgcaatcaaaaatacgtacgtaatactttgtgacatcgcatcaatgactttatttaaaatatcaggcggaatttgtgagcgggcaccttcttgaaaaatggcttgtggatcgcctatttgagaagaggcacctttcattccgctaaaggcttctgctaagcgattcgataggacattggtttgaatcgtcccaaaaatcgtgacaccaagtgtcatcccaagtgatctcataaatgaattggtcgagtttgcactgcctcgataacgaggggctagatcattcattgaagctgacggcagaagggagaagctgaagccgacaccaaagcctgatatcatcataaagattgtgagccaaattctagctgtatctggtgacatattggcaagaagcagcatccccgcgaaaaatgaaataacagagatcgtcataagacgtctgaaaggcactttcgtctgcatcgttccgccaatcatactgccaatgacagaccctatcatcatcggtgttaaaatgaaccctgcacttgtcgctgattcaccgtacaccgcctgaacgaaaataggaatgaagacagcaagaataataaatgttccgccatataaaaacgccaaaatttgagatgtcgcaaataaacgatttttaaacatccaaaatgaaataatcggttcctctgcttttcgctcaacaataaagaagatggtaccgaacacaagaaacacggcaaaaagggtgaggatttgcactgaatcccacgcataagatttaccaccaagctcaagtgcgaacatcaagctcacaaccgccacgacaagtgtgatagcacctgaccagtcaattttttgcttgcgatgttctagtgattcctggtagtatctagcaatcaagaacacactaacaataccaattggcacgttgatatagaaaacccagtgccagccgattgaatctgtgataatagctcctaagagcggtcctagtacactcgataaaccaaacactgcaccaaacataccggacatttttccacgcttttcaggcgggaagatatcaaagatgattgtaaacgcgattggaagaagggcgccgcctccaagcccttgaatggctcggtaaataatgagctgatccatcgtttgtgcgataccgcacagcgctgatccaattaaaaagaaaataagtccaaacagaaaaaaacgctttcgaccatacatatcagaaagctttccgtaaatcggcattccagccattactgccaccatataagaagccgtcacccaagcaaatttatcaaaactgcccaaatctgctacgatgcttcccattgctgttgcaacaatggtattgtccatcgccgccataaaaattcctaacagcaaaccgatgacaacaaagcgagtggatgccttgcctttatccacatgattcatttcatttacctcctgcttacgttctctccttatttttgctatgatcaacttaaatataaagtaagagaacatttatcttgatgatcaagataatttattttaaagggaggagaacaagttgtcaataaagaacgacgcagaagacagagcagacctgatcatccatacaatgaggcgcctcgccacacgaacggttttattccaccaagcggccgcacaatcgcttggccttttcccaacagacctcaaatcagccgatttattaaatgaactcggtcctctcacagcaggagaattaagtgaaaaaacaggtcttagctcaggtgcagtcacagctctgattgaccgccttgaaaaagcgggctacgcaaaaagagaaaaggacccaaaagacaaacgaagagttatcatcgttccattaacggcagggaaatcacaggtaagagaactcttccaatccttatcagcatcaaccaaacagcttacaaacgaatacaaacgagaagaattagacttaatcattcaatttattaccgaagcagcagatattatggaccaagagctgcaattgcttaagtctaagtcgtaagagagcataatgcgaagggtgtgcttttctattagttgtttaaaaaaggtagcgcggattataattggctcaattagtgccctcttccttaccatggaagtgctctattacacttgtttacaatggaacatctcaaatgattttaattaaaagatgttttaaaaatcgtgtcttaatgattactgacgattgctaggctaaagcgctctaataaaacacggatcatttacatattaagtactgtttttgtatctatattcctatttaatgacaaactttgtgttggtaaaattgaccttgtcaatgaataggaaggagtgaattctgctggggaaaatacttgatgcaaaagcacttgaaagtgccatggacgcaagagcaaaacactaccaggaactccgcgaacaaatggtagatttaaaaaaagcattacaaggtgtttctaatctcggtgactcgacatatgaaatggagaagatgtttaagcgtgtgatgtagcaaggtattagatggtgggtgaataggtttgcccaccatttgcccaccgattaattttcaaggtacttttcaaagcgcaaaacgctttctgtttcgtgtttttttgttacgtgaagataaacatccgctgtcatgttgatggtagcatgccccagtctgtcactcactgtttttatatcaaccccgctttcaaggagcatgattgcatgagtatgtcgtagcccatgaggtgtaatgtgatgtaaatttgtttttgacaggatcgagtcaatagctttattaatcccaaatgttcctatatctttcccattgggtgatgctatcaaaaaattaggttcttgatatgcaaccccatatttaattttgtttttcttttgccatgtacgatacttttttagttcagttattaatgtgtcatcaattgcgattgtacgaatactagactttgttttaggtatctttaccccatattcatttcttgatttattaatccgtatcgtcttttggttaaaatcaatgtcatcccattgaagagcgatcaactctccttttcttatcccagttcttaataaaattaatgcaatgatgtaatgatggaaacgggacttttttgcagcattaataaatatattcacctcatcttttgtaaggtaatttatcttgtcatcatttacattactatttttttttatagaaatatttgaatacttattatgcgttaacatttcaagttctactgctttatttattgctgaacaaaatattgaatgtatggtttgaactgtagatttagcatacttgtttaatagattgttgatatatctttggtaatcaactctttttaattgacctaatttgttctgtccgagatgggggatgatattcttttcaatatacaatttacggttctttaaggtgctaggctgacattgagaaccgtaaacatcaagccattcatataaccagtcttttaataatacctctttactttggattatttcatgttgacctaaataaatctgtttttcaatttctgctgcttcaatttgtgcttctttctttgttctaaatcctcctttgcttttttcttttcgttttcctttagagtcagtaaagataatacggtattcccaactcttacctcgttgtctaaagctagccaagatagttcactccctgcttttatttccagacctattaaagagcatatgttcgttttttgtttaaaaaaatactgtggtaattttgtacaagttctttcggaataccatattccttaaattcacaataagtaatacccctttgaacggaagaaaacaataaatgcatagcaaaaaagtttgcttccagttcaattttttcagttgaatagaaagtgtttctttttaaaaaaggagtattagattcgctatgaagtaaagcatgtcctagttcgtgggcgcaaacaaagtaaccacatttttcacttactttttcattgatatgtatgaattttgtgcgaaaatgtttgctgtagtaccccagggtattccctaagtcttcatgaattgtaatgatattgagtttgttggcaatgaaataaggatcagatgacttaaatctactttgtaattttgaaacaatttcagtaatatcgcccatgatttaaaatatcattccttatctatattttttaggagtgtatttttgttttgctattttctttgctattctcaaagtgttttcaagactagcgattaaaagttctttatcttcttcttccatgtcatcaatggtttgaccgtcaaaagcagcataactattcccttcaagtccgtttatgatgttttgcaattctttttgtatgtccttctcatcttttcccgttaattcaatacttcttttaacttctgtgcgccctaataggtaatcagttgatacatcgaaataatccgctaccttttgtaacgtctcacttttaggagaaacattgtcccaccttctaatttgcccgtttgaaatacctatttgtctttcaacttccgcaaaagtgactttcttttcatcgcaaagcccttttattcttctaaccaaactcattctgaccaacctttctcaaggcttatcgaaaacaaaatgacttaaaagtcaatattttatattgacacgtgactttaaagtcattatactgtgatcataagctaattaattagcaaaaaagacaataaaaaatgtacccaataaaatacactttcgacgctggggagcaatgaaatgttgtatatttaaaggcttttataagtcttatttcgctatggattaataatagcaaaaaagtcattttgggtcaatgagaattagctaattaattagccttttatattttttggaaggaggctcaacttgaatcatgtcgatcaacggagctataaaagtgaaatcagaaatgtataaacaaggaatcactcaaaaggaattagctgaaattcttggtgtatcgggggcttatgtcagcgatattatcaacggaaagaaaacaggaaagaaagcccaagaacatgcaaaacatatccgaaaaatcttaggcattaaaggaagtgaggaataaatgctaacctttcaaattgatcaaaatcttttagaagaacaggtgtcaaaggagctttcaaaaagacttgaagcgattgaacacagggttacattttgggacacaaaagaattgtgtaagcaaacaaacatgagtctcaacttcataaaagaaacattcttttacgattcgaggtttccaaaatatcgagtcggtacaaaatggctttttcctgcaaaagaatgcgaacagtttttaataacttggctgaaagaacaatccaggggataaagttttgtttgttccccaaaagtggggaaagacgcaaattaaatatttataaacccgaattgacaggaggaaataaagatgaacaccaatacaaaaaatccttatgcacctggtccggtgaaagtatggaaaatgacgaaagaagaactcgaagcgtatatagaaaagcatcctattatctaccgagaggaattaaaaccgtcaccaaccttccgtacgggtaattggggggctgaaaaactgtgagtctaccaaaacatatcgagttgttgcacaccgtcaaagcctgcaaaaaccaaacaatgcaaattgaggacgcagcgactcatctaaaagtacctgattttgtcattccaatgttagtcaaaaaaaatgatgacttgagcattcaagggaatctgattctagcaaaaagcgattcaatcggacaaggcattttcatactactaactttcattagcatcatcattattaccggatttttcggagagtaaggagtcaagccgcttatgattttcatcacattaaatagatttataggaggtacaagcatgactaataaaatcgtttgtccaagctgcaagagtgaaacgggcttttttactaaagaaaggatcacgggttcagctaccgtttattacaattcaaatggagatttggaagaagatcaaagcacaatgtatgattcgatattacattatggaggttcaaaagcgtattgccgaaagtgcgaaaaatttatggggcgtactgatgaattgtggagcggcgatagagaaggaatataaaaaactgatccgctcgggatcagtcaaacttcttacttgtacattatagggttgttgcaagtaaggaaggtacgggaagtgtagaagcttccacatattgatttgactttaacatgattaacaaaaaaatacaataatcaaatttgagataaaaaggggatttttctaatgaaattaatgggtacgcctgcaaaggtttctacagttagagcaaagttacagcatatcggacgtcaagaagataaagaggctcatttctatgatgcgggcatggtatccgttttaaaatatgttgctgccaaaacaattcatgaaacggaaggaacagaattcgaatggtctgatgccactttacggacacaagagaacgtggatgatttgtacgagaaattagaagggttgttatctcatgcaaatgattttgtgaagctattgaaagaccttgatgatgctcaagcagcaaaagccagtcttgaaattgaagatgcttatgtaactggattcgtagaaggtttccgctatttgatgggtgaagcagcatacagacaaaatgtaaattttctaaagtaaggtgatttcataatggtcggttggattaagttgcataggaagattagaagtaaccccattttcaatgatccgcagctattaaggttatggctaatatgtctaacagaggcttcacatacggaacatgatcagatagtgggtagacaaaaagtgaagctaaagccaggtgattttgtaacaggtcgttttgctttgatggacatgtacaataccggtcttaaatctaaggacagggtaaagggagaaaagacaatttttcgttggttggaacagcttcaagaaatgggatatttgacaataaaaaagaccaacaaattcagcattgtaagcattgataattgggctatttatcaagatggagcttccgaaaacgacaacagtctgaccaacaaaagaccatcaaatgaccatcaaatgaccacaaacaagaatgtaaagaatgataagaatgaaaagaagataaataattctcgtcacaagtacgaaccttgtgacatggagaatgccaatttgctttatcaaagaatcattgaaaataatccgcaagctaaaaaaccgaacctggaaaaatgggcgagtgattttagattgattaggcagatcgacaagcgaacggatgcacaggtgaagtatttgattaactggacacaaaaagatagtttttggaaatcgaatatattgagtcctgcgagtcttagaaagcagtttgataaattgaccgtaagaattaaaagcgaaagagaagcagcaaagagaaaagcggctgtgaatgaaaaggagtttgatttgacagatgactaaagcagagacattagagttacttaaactaatcaagacatattatgagcattttgagtttgatcaaacaaagctagacgcatgggctagaatcttaaagcccgagaattacgagcggatcgaggcgaatttgatcgtttatgtgaaatacaatcagtttccgccaaaagttgctgatctaatcaaagcgaaagaagcaagaacagatcggtccgcagccataccgaacgttgaggaaactcaaagctatctttctgaactggacaaggctgaaccaacccaagaagaactagaacagatcgagcagcataaagcaaagatacgaaaattgcttggaataggtgaaccgtcatgacaggaaacatattttatttcaacgacgaagcggaacaacaatatctaggcgcaatcttacaagagccggatttgatcaaatattcgcagctcaaaccaattcatttctaccgaaagcaaaatcaatccatttacaaagcctttcaagagctggataaaaacggcgatcctatcgacatagtgtcagttattgaacatgtgggacgagaaaacctaaaggggatcggcggaagaaaatacttaactgaattgatgaatgcctcaatcactacagcaaaacaagcattctatgaaaatctaataattgattattggaaaaaacgagagattgcgaaagtgggtgtttcgcttaaagaatcttccaatagcgacgatacgtgtcaaactatacaagagggtataagctctcttatgagtttagaggatgcgacaggcacggacgacgacgggtctatcaataatgacctagttgaaatctatcaagagttagaaacgcctaaaggtgatgtaactggtatgcctagcggctttactgaattggaccgaatgacgtcgggttttcagcggcaagaatttataatcgtcgccgctcgtccatccgtaggaaaaaccgccttttgtttgaatgtagcaagcaatttcatggaaaacccgcttaatttaggtaaaggcggagcggttggcatcttttcgcttgaaatgtcacgtaagcaattaataaaacggatgcaatcaagtatcggtaacattaatgctcaatccatccgcacaagtaatttaaacgctgatgagtggggcagattaagcaaagtgaacggggttttagattgtgccgctcttagaatatttgatcaaccaggcatgacgataaatgacatttgggcaaaggctcgtaaaatgaaacgggaatttgaaggcaaggacatgatgatcattattgactatctgcaattgatcgtcggaaatccagtccacagaggaaacagacaagcagaaatcggagaaataagccgtatgctcaagcaaatggcaagggaattggacattgctgtcattgcattgagtcagctttcacgtggagtcgaacaacgccaggagaagcgccctatgatgtcagacattagagaatcggggcagatcgagcaagacgctgatgttattgcatttctctatcgtgatgactattacgacaaagaaacagagaataagaacattattgaaatcattattgctaaacagcgtaacggtccagtcggtacggtttcactagcgttcgtcaaagaatataacaaattcgtcaacctggaatatagggaatcggcatgacggttaaagattggtataaagaggcgataaagctcaatcagtacgccttgatattgctgatcgaattcctagtatacgaaaaggcagtaataaaaatgacggatcaagaagaacagcttttcttttacctacagccaaaatttaaagaaaagatgaatgagcatttaaagaactatcatacaaaaattcaattggaggaatcgggcatatgagcaatgaaaaagagcggttaacagaagatcaaagacaattttttattgaatggctaaccgttatcgggcgagggtattcacgggagttttacgagaaaatgaatgaccaggaactagaaaagcaatatttgcttaacgtgccccaagaagtatgaacgagccaacgatctttattaattcgcgaccggaaactataattatcatccatgaccgtgagttgttaaagagaggggttataagcaaataatgataaatcattttatttaaggagagtgttgtaccatgcgtcaaaaaaattaaaccatcttgaaaagatggtttaacctctaacttttaaatttttcaatagtagctgacacaaagctccttacagatgatatcttgttctgtttctctttttgatgaattttttcatcgagtattaattcgatggcaagttgtactttaggaaatagatcaagacattcttcttctgttaactcatgtatacctttgcttaaaattgcatatagctttctgttttcaacaagtatgcttggtaaataattcttaagtagcttaattttatgatccatttttgatccttcaaagtcgctattgttccaattagtactttgttctaatgcgatttgtctggtttcttcaattaagttttcaaagattctacgaagatatacaaatgaacctgcgccaatttcttgagaattcagtcgtattgccttagaaaaatctctatagtcgttctttaaaatggttttatactttttaatcttatgtaattgaaggtcagcaatagatggatattgtccaatctttgtaactttgttttgttgaatgagtaccgagaaatagaataaatgcaattcatccctgtggcatcggaatattaaagcgataggcaattgtgtttgtattctatctatagctttttctggatagtcatatatagtgagtggtttcaagccaccggtttgactatgaagattaaaagttgattcttttttacattcgatacagtaacaatcaaattgaattatttttggatttcttaaatatgattcaattatttcagcattctcatcattgatgattagggatcggtacagtcctaaatctaatggtaaaaaatctggggataaattatgactcaaataaaccagctccattcaattatttatcataattttaccacaagagtatgtgattggtattaagagtgcctgtgaatttgcttatcaataatataaaagaacgcctagcaatgaaaaatatagagattttaaaagggagaatagcaaattgagtaattgaagaaacgttaattatatttttcagtgtgtttgactcaattttcgcttttattattcagcatataattaaaggaggcaatgaaagacttgagactaaaagagattccaagtaaaattatagagaccttagacataggaaaagagcccatcgttttagttttttctgatggcacattgaaatatacacaattaccgccgcatggtgaaacaaaaattgtcactcacaataacaaagtgactcgattgatttttaacgaaggcgtactatttgaataaaaccgttctaccggaaagccgggggacactgatcatgacagcaaaaaagcgctgtgtgattggtgtcccttttttatattcagaaaagaaggacacgaggtgtaaatctatgtctaaaaaaagaactgacgtttctaagaagaaaagtacccaaaatcgcacgcaggagctttcagacaaagagataaatgcgctaatgggtatttccgccgaacatatagaagaggtagcggcggggctttaaaggataaataaagggggaggatattttatgttgggtgaaccacctgtaatagataaaaaagaaacgagaaaaagagttgaaagaattctcgacaactatcgtttgtatctccttcaagtcccggacgatatgctgccgaagataacaggaggattcagtatcgtgccgcccgccacaagcaacgctttccgctcatccacagaaagcacagctattaaacggattgaatgggagcagaaacgaaatacgtttcttgaaaaggtacaaagagcgatcaatcgtcttccgtataacgagaggcagatcattgtaaaacgttacatgcagcaagaacctgttttcgattaccaggtatataacgaaatcggcatgagtgaaagaacgtatacaaggttaaaagcaaagactttcctagacctggcttacgctctcaatgaagttgtgtttaaagcacccgtttagagatgtttttttgttcgacaaattttgcggattataaaattttataagtggaggtcgataaaagatgggggtgaaagaattgactagaaattataacgaagctaaaactacaataaaatatttagaaaaacgttatggtaaaaaattttataacttaactattgatggtcaaaaggaacttcaaagattaattattttagatcataataaagatgatttaaaaagaatgttgagaagaattaaagccgatattgagatagcgaaagatacacagtctattaatgtcttaccatttaatttttacatgataatgatcggtacgttaggttctgcgagcgttggaactatgtctctactttttatatttatgaacagtctttataataaatatttagaaactaaagattttagcaatgtagaggtatcagaattgacaaattttatagattttacattaattcttaggttaacgattattgctattggtataccttttttggtgatacttggtttatggtggtataaacataagaaattgacagataatgttgataagcgttacttcatttgtatattgctagaagaatgcctagaatttcataataatatatcacaacgagtagagccaacgaacagatattaagcagaatgacaaaagaaagcgcctttcacggtgctttttttattggcggaaaactggcgtgtttttggcgttatgttggcgaagcatgacagaaaaaaggttgtactattgtattatgtattagagaacgttttgaaaagaaaagagatcgttttttcgttcgacaaattctgcaactccttcaaattagccattttagttcgatattttaattgatatgttaaaagcattggaggagtccagttgagacaacaatttcgagagttttattttaataaagatgataacgatatttgggaagaatcaattattgtcttagatacaaatgttttattgaatttatataggtatactaaagaaacatcagatcagatcctaagtttattacaaaaatacgaaaaaaacctgtggatgcctcatcaagtggcgttggaatatcattataatagaaaatctgtaattttagaacagagtggttcatataagaaagtatgcgatacatttaatgatgtgcccgataaaattagaaatatgctgaatcaagatttgagtaattttaaaaagaggcacaaagatgatgtagatagtttcattaagattattaaagatattactaaagaacaaattaataaactaaaagatagaaatgatagcgaattggatttaacgaaaaaagatacaataaaaaataaaattactgatctatttttacataaagtaggtaaaccatatgaagaatctaaaatgaaaggtttagaaattgaagcagacgctcgtttaaaaaacaaaatacccccaggatataaagattatgataagaagaaaggtaataaatttcataacggtgttgtcatacaaaataaatacggtgatttaattctgtggaaacaattgctcgattttgcaagagacaatgaggttaatataattttcttaactgacgaacaaaaggaagattggtggtacgatataagcaataaaataattggaccaagaattgagttgttaaatgaattcactcatgtaactaataaagagtttcatatgtttagctcaattggctttgttgaaagacattcaagttattttaatgaaactgcagtttcggaagtaagagaggtaacaaccgagtacacaaacgcagaaaaattagcttttttaaataatcaattttctgataatagttcttatggaaaatttaataaacaattagacgctgctatgaggcttaaagaaaaaggtgtcaaaatgttgaacttattttcagaccttgaccaaaaaaatttatttgaagtaaaaactaatgaagaaatttatgagataataagcgaaagcttacatacgaaaatggagaaaagttcgtttctaagtttttgttattggtttaaagattatgattatacattcgatgaatttgaggaggaatatgaacgtttttatactaaagttaaaaatgaatttaatctatacattgctgataaaataatgaatattttatataggctaaacatagtcgagactgatccagcaaataacgcctgtattaatatgaatgaactgagaaatgttgtatatggttatctggtggaatatgacaaataatttaaatagtaaccctttttagtacccatttgggtgcttttttgtttgatttaaagtgctctacatgaataagtaaaggtgatgaatgatgccgctaaaaagatgtaatgcgtctgcctgccgagaatatatagattggaccgaacgctattgtatgaagcaccagggctatgctgataagcaatacaacaaagatgtgaggtacagcagggagaacgaagcgtactacaaatactatcaaagtagagaatggaaatcacttcgagaagcaaagaagcgtgagagtcattacagatgcgctgtatgtgccgcagaaggacgtgtaaacatgtccaataggttagtggtccatcataagcataaagagcttagagcggtatttcatgatgatatagagcgcaatgatttaaacaaccttgaggtgctttgtcagtttcatcataatcaaattacattttctaaaaaatgaattataattaacttaattccatttgagagggagagtatattgcgtaatgattggttggacctttttagacattatggtttagtaaaactaagtgattatgcggagcatgtagaaagcacattaaatcatcaacttgtcgaaattgatagatatattgatacatttgagaccacagaggaaaaagaattttatgttgatcgaatttatgatgaaatagcagcttatagtgatgacttcccagcaattatgagagcttcattgctgattagtatctattcttacttagaacatgaattaaataagttatgtcgatttcataacgaggaagggtttatgacatataaaaccaaagccactggcatagcacgatcaaaagagtttataaaaaaagaacttaagatgaattttcctgaccaaacaaaggagtggaatttcatttgtcatgtaaaagaaataagaaattgttttgcacatacacaggggtatatagatatgatgagtcaaagttcacaaagaagagttaggcaagcaattaaatcaataggaaaagatttaatttccgaaaaggagtctttaaaagaaattcagttacacgaaacgtttaataaagaatttataaaaaatgctgaaaaattcctcgactatatttatgaagaaataaagtccccccgacattaaacggggtgggcttttttgattcctggaaatcggcgtcccctcaactttaagaaaagtgttgaaatggagttttgatttttcccgttttttgcggtttttcactcattcataaaatggattgatcctttacaggcgttgagatagagctattttactcatttgtttgattgtcttaaattaataggttggattttgctgaaaggtggtggtttttattggcgagaagaaaacaattgacggacacattaaaagggcaaatatcgaatgaagaacgagagcagcgacagcagcatgaagaaaaattgaaaggcatatcgccattgaaagagaacccgccttattggctgtcaacaatggcaaaaaacgaatggatcagaatttaccctcatattatcgagctgccaatatcggaattggatcgcactttgttggctatgtactgtaatagttacgcacagtatcggcaggcattagaagatgtggcagcagagggacaagtcgtttttgaagtgaatagtaaggggtttgaagtgaaaaagaaaaacccgtctattgaaatcatgatgcaaatgtcgaaagagattcgagccattgcaggacaacttggtcttgcacttgatgctcgattacgtctagtcggtttaggtgaagagagcgaggatgacgatatatttgaggcaatgaggcaggatgacgacgattaaaaatgaccccggtactctttacgctgaaaaagtagtaaacggggaaattgtagcaactaaaaaagtcatccaggcatgcaaacgacatttgcgggatcttgaaaaatcaaaagaccctaactatccgtacgagtacaagcccaaaaaaggggcaaaggttgtaaagtttcttgaaatactgccggatatttcaacaggtaaacctacgtcactggcactctttcaaaaattcattgtctatatgatatttgcctggcgagacaaagaaacaggatatagacgatttacaaaagcatatatcagcatggcacgtaaaggcggtaaatccgttcttgtggctggtatagctttatatgaattgcttttcggtgatgcgcctagatacgatcgacagatttacacgacggctaattctcgtaaacaagcaaaagcggtttttaacatgattgtcatgcaacttaaaaagttgcggaagaaatcaaaacaaattaagaaaatgaccaagattattcaaaatgaaattcgttttttgctagaggatagcatcatcatgccgttatctcgtgatacagataaccttgacggcttaaatgtcttgattggcattcttgatgaatttcacacagcgacaaacacaaaaatgattgaggttttagagtcctcacaaggtcagcaagaccaggggcttatcttgatcattagtacagcgggttttaagctcaacggtcctatgtatgctcaagaatatccatatgtaacggatatattgagcgggaagaaagagaacgaaaactattttgcggttgtctatgagcaagatgatgaaaaagagataagcgacgagaacacctggattaaaagtaacccgttgcttgaagttgaaagcatgaaaaagaaattgctcaagaacttacgcaaaaaattgaaagaagcccaggaaaaagacgatctgaacggaacgcttgttaaaaactttaatttgtggcgttctgcctcttccgatagtttattgaacggtgacgattggaaagattgtgccgtcgaggaaaagccggatatatacgggaagcctgtctatatcggtgtggatttatccaggtcggaagatttatcttcattaggctttatttatcctttagaggatgccgaggaaaacttttatgttgatagtcattcgtttgttggtcgcaaaggcggtttagaaaacaagatacagcgtgacaaaattgactacaagcggcttgagcaagaagggtattgcacaataacagacaaagagtccggcatcattaatttacaacaagtgattgactacatggtcgatcacataacgaaaaatgatttgcaagtgaagggcatcttttatgatccatataacatttcattattcctaaatgaaattgaacattacggataccctgctattgaagtaaggcaaggggtaaggacgttatcagagccaacgaaaaactttagactcaatgtcatggatcaacgtctattgcatacaaacaacccattgctcaacctggcaataaacaatgccattttgaaaaaggtcaatgatacggtgcagatcgacaaggatttaaaccgggaaaaaattgacccaatcgctgccgttatgaatgcatatacagaggcaatgtaccattacgagcaaaacgaaacggattgggacgcctactatcaaagtgaagattttggaatatagaaggaggggaaagagtgccaaaacaatttaatcatctaattttaggagtatggcggttcttcatatcgaaccttcatactcttttgtttttgttagggctaatcctcatcaataccgccgtttatatggtcgggatgattttggggattgcggctagtggtattttgctagtctttgtcgccattcttctcaaccatgaaacagaaagggggtagagggaattggcgttctttagatcaatcaatcaacaaagcgcaggacaaagggaatttaacgaaattttggtgggcttagatggtttaagctatgtgccggcaacagctattaaaaatagtgatgtgttcacagcggttcacgtgttggcgtcagacatagcagcaagtccgatcatgattagaaacgaaggaatagaagaaaaggatagtgacttgtttcagcttatcaacgagcgccctaacgaatattactcggggtactcattcaaatatattcttgtcgccaatgcgcttttaaacggtcaatcgtttgcttatatcaaacgggataaagacggcacgccctgggagcttattcacatgttaaatagtgaagtctcggtagatcaaataaagggacggaacgatattgtttaccgttattacccttctgacggaaaagaagctattttgaaaccgtctgacgtgctgcatatcaagttttcctcactggatggggtaaacggaaagagcctcttatcatgtctcaagcacgaacttgaaagccaggaagcgggcaaaaggcttgtcacggacttttttagacgtggcacaaatttaagcggcattgtaacgcttaaaaaaggcgtaccgtcgcccgaagcaagggaaaacttgcgtaatgaatttgaaaaggtcaattcgggtgttaggaatcaacaaagaatagcggttttgagcgaaaacgaagaatttaagcagctagaaatcagtacaaaggttcttgagatcgtcaacaactacacgcattcaaccaaacaaattgcgaaagtgttcgggctgccgcctcataagttgggaatcgagcaagtgaacacttcactagaacaagcgaacctggattatttgacaaacaccctttcaaattactttgctgccattacagcggaattaaatttcaaaatgcttttttacccggaaagcaggaccaaacgttttcagtttgacgcaagacgttttaaggagacagacgctaaaacaaagcgggaaaatgtcattgcattacttcaaaacggtatttattcgcaaaatgacgcattagcagaatacggaatcgcgcctattgaaaatggaaataggcgctttatgagtttgaactatgtggatgttgacattatggacgaaatccaaaaagcaaaggcgaaggggcttccaattcctacggtcgataaagggggtgatgatattggagaaggagattagagccattcaggaaggttcactaaaagccacagaagaaaccgataaaggcagaatgatcacaggttatgcattgaaatttggtacacgcagccgaaacctgggcggctttatcgaaaccattgaaaaacgtgcgctgcaaaatgctgatatgtcagatgtaagggcgcttattgaccacgatccttctaaaattttgggaaggaccaaagccggaacactgaaactatctgtggatgatattggattgcgttttgaattgtctctacctaacacgcaatatgcaaacgatctatacgaaaacttgagacttggcaacatttcaaattgttcattcggttttcatcttgcgaaaaacggcgacagctttaaacgtgatgaaaaatcggggctgccgttgcggagcttaacgaatatttcacggattactgatgtttctatcgtcacttatccagcttatgaagatacagacgtatcaattgcacagcggcatttaaagcagcatcaaagcagccatttagaaaaagaaaaaatcaagttagagcttgatttaattgaattaagtatttagaaagtactcgtatattgcgggtgcttattttatttggaaaaggagcatgtacacatgttaaaagagaaaatccaggaattacgttcagagatcacaaagagacaaacggctatcaatacaaaaatcaaggaggctcatcaaagagcggaagaagacaagctagaagaagcaaaaacgattaaagatgaaatcacttctttaaaagcagagattgagacaatgacagaaaagctaaaagaattagaagaattggcaggaatgaaagcggaggaaatcacggaagcgggacaagccggaacagatgaacaaagatcacttccattagtcacaccgcatgtgcgcttggataaaggaattgaggaacagcgccgcagctttgaaacattcttgcgtactagaggtgaagtccgagacggtttgacaacagaaggagcagcggcaattattccgattgaagtcattacgacaccgcagaaaacgcccgaagatattgttgatctcgttgaatttgtgaataaagtcaacgtgacagcaccatccggttcatatccagttttagaaaatacagaaactgaacttgtttcagttgcggagcttgagaaaaaccccgatctagcaaacccaaaattcaataaaattgattggaaagttgaaacgtatcgtggtcaattggctatctctcaagaatcaattgatgattccggcgttgatttaacggcacttgtagcggatcatttgcaacaagtaaaacgaaacacaaggaatacaaaaattgcgggtgtcttaaaaacttttacagctaaaacagttacaggaacggacgacattaaaaagattttaaatgttgatttaaagcaagcatatgcccgtaatgttctttcgacgtcatccgcatttcaattcctagacacgctaaaagacaaaaacggtcaatacatcttgcaaagtaacatttcttcaccatccggcaaaacgctttttggaagcccgatcaaagttgttgatgatacattactcggcaaaaaagccggtgatatgaacatgtttatcggtgacttaaaacgagctgccttctttgccaatcgtgtagacgttgttgcaaagtgggttgaaaatgcggtgtatggtcaagtcctttcccttgctattcgtttcgacgtaaagcaagcagacaaaaacgcaggcttttatgtaacaatcaagccgccagttgaaacaggcgctacagaataggagtgaagaaatatgacccttgaagaattaaaacacgctttaaggatcactcatgacctggatgacaaaatgctagaaaccataaaagcagcggcagaaaaatttataaaagatagcgtcactttatcgaaagatagggacgctttttttattgataatccttgttttgatgatgcggtcatgatgctttgcggtcacaggtacgaaaaccgatcagcagtatcaaacaagaatctgcaagaagtgccgttcggcgttatgtcgtacattcaacaatttaaaggagaatacccttcatggactatggacgattaaatacgccgatctcttttgtgaaaaaggaaaatacaaaagaccctatatccagggagaacacgaccacattagaaagacttttcaccacctgggcggagcggagagatcaaaaattaagagaaaagctatcaacaaccggaacggttttagaggatagtttgacatatgttattcgctatcaacaagtatcgaccatttcaaacgctatgcacgtacaggatcacttgaccaacgagctttatcaagtcattgatattttgccaaacgagcaggacaaagacttgatcaatgtctttgtaaagaaggtgagctgatggcgcttgaagctaatggaatagaagaaacatataaagccattgaaaagatggctcgtcaaaatgtaaaagcggaaaaggctgccgttcatgctggcgcaaaactaatggcagatggcttggaaaagaacacgccatttgatagcaatagtggcaatgagaagcatttaaaatcagatgttttctattccaaaccaagagaggacggggaaatatattcaaccgttggctatggtaaggaaacggcttataggctacattttactaacttcggaacgatcaagcagcgcccgcaaagttttatcgagcgcacgatcaacgaatatgaacaactcgttttatcaaaaatgcaaagtgtttatagggggttgctcgggctatgatgctgccaattcaagaagtagaaatgattttgacaggatcgtccgatctgacaagctacgtcccggatgaaaaaatctatcttgtggacgtgccggagttagatcaaaaggtagatcaagccccgatgatccgtattaatgagcttgaaagctatcgtaatgcttatgaggatgatcaagcgacaggcataagcgttgatatacaaatagatttatggactgggacaatcaaggaagcacaagaaatacaaccgattattgatcgtttgatggcttcggctgattatcagcaatacgcttccgcatttgataaagacccggatatacaactgtacagatatgcacgaaggtacagagcaaataaagaaatagaaatcagtttttcatagagaggatgaattaaatggctacaacaggattgagagatattagagtcggcgtttttgaggatgacgccgccaaagaagcaaccgaagtaataaatgtacctggggcaatagaatcgaaattagaaccaagctcggaaattgcagtgctttatggtgatgatggcgtatttgatcaagaaggatcgggggttggtgaagcaaagctagaaatcggcgtggctgatcttacaactgaaatgaaaaacaaattgctaggagcggatgccattggcggatggcttgaagcatacggaaaagatactgacccgcctttcgttgctatcacattccggcagaaaacaaagggcggtttttggtatgttggacttttgcggggtaaattcggtattccgtctaatgaaggtaaaacaaaagaggataaagtcgaatttatcacgccaacaattgagggacaatttatgccccgtaaatctgatggtttaacctatgtcatggcgtatagtggaagccctggattcactgaaaaagccttttatgattttgtttttaaagggatcgcccctagcactgacggcgacaacggaacagcggaagcaccatcaagtaccacaacaaaaaaatagtgttttctgatagccaggtaatttattttacctggttaaactggattcattaaaaaatatacgaggtgtttaaaatgttgaaattaacaatgattgattcacaaacaaaagaagaaaaaacgtacacaaaagatatgccttcggctcgccaattaagacgtgcgcttgaattgcaagctcaaggtgaacaagaaaatttggacgcaacaacaatgcttgatgaaatgattgcctatgttgtggacgtattcgggaagcagttttcatatgatgactttttagacaatgtcccgtctgacgaaacatttcaaaccattgctgatgtcatcatgcaagtgacaggacaaaaaaagggaaacgacggcttgaaaaagaaagcggtgaaagcacagaaatagagcatttggaaacttggcaagattacctagattcattagatgatacttacgaagatttgatgaaagaagggtacaagtatcatgaaatagacaacatggacttgaacggatttttgcgtcttgcgaatcgaaaaggacaaagcgagggcagcgttccaatagatcagattttaagaccaggaggcttttgagccttcttttatttttgaggaaaggaggtaaaccatatggcaacggaagggcgtccgataggttctttagtcgttaatacgacgttagatagtacagggtttgacaaaggcgtcacagccttgaggcagcagcttaaaacggcacagtccgcaaccaaagcaaccgcagccgaatttaaagcattagatgacaagctgggagaaagtaaaagtaaggtatcgggcttatcagatcaattaaagattcaagaaagaatcgtagactcttatcgtcaagcatacgaaaagcaagtggagcaatacggcgagggatcaacccaggcgcagaagtacgcacaacgtttaaactctcaaataacaagctatcgcaacatgcaaaatgctttaaggcttgcacaaagtcaggttgaacggcttgagcgtgccgaatcagaagcagcaaacagcgccgacgatttagcaacaagtcatcaaaatgtatctaatgatgtaacggcagcgggtaaagaggtttccaaactctcaagcattttaaagggcggatttgctacggcagcggtagcgggtacggtagccattggagcattaacggcagccgttggcacgcttggcgcaaaaatgacggctgatattcaagcgtctcaaggtcgtttaagagcgcagctaggtttaacaggcgatgaagccaaaaggctcacaggcatagcaaaagacgtgtgggcacagggcttcggagagaatttggatgacgctaggaatggtctgtttcaaattaaacaaaatatccgaggcattgcagacaaggaccttacggacgtaacgaaaaaagccctggtgcttgctgatgcttttgattccgaggtaaacgaagtggcgagagcaggcaacaaccttatgaaaggttttggcgtgactgtgagtgatgcgtttgatctcatgacgtatggcgcacaaaacggattgaatttttccaacgagatgttcgacaacctatccgagtattcaacgttattcggaaaaatgggttattcagcacaagaatattttcaattactcgtcaacggaacaaaagcgggcgtttacaacctggattacgtcaacgacgtcatgaaagagtttcaaattcgtgtcaaggatggctcgaaatcgactaatgaagcaatggcgagtatgtctaaaccgacacaaaaggtatggcaagaatttttaaaaggtaaagggaccgtcaaggatgtatcaaacaccgttttaaaagagcttaaaggcatgaaagaccaggtggacgctaacaatatcggcgtggctcttttcgggacaaaatgggaggacttagaggctgacgccatgtatgccctgggcggcattgatggaaaaatcggtgacgtaaagggcaaagctgacgaagcaggggcagcattgcaagacaatctaggcacacgctttaaaaagatcgggcgtcaagcactgtcagcgctagagccgttaggaggcgcggcggctacaatgcttgaaaaagcctttaatattgctgatccaatcatgaaagaaatgtccagcgctggcaataccgtaaaacaggcaatggcgggtatttggggcataatgcaaggcgagggaagcgctgaaagattagaaggatacggcatattatcgcagtttttcccgcctggcgtggttgatatgattgtaaacactactgatacagtaaaaggtgtgattgatagtataaaaagctcgtttcaaagtatgcagccgacctttcaagcgattggcggcattttgatgaatgtatttgtcacaatggcgccgattgtaaaacaagcccttggcggaatcttgtcatttatcggacagcttgccacagtgtgggggacgttttggaaggaaaacggcggtgtgattacacaagccttacaaaatatatggtctgtggtccaattcgtcatgcctgccattattgccattattaaaagcgtttggggcaatattaaaggcgttgtcatgggcgcaatgcaagtgattcaaggtgttatacaattcttctcgggcttgctgacgggagatttcggcaagatgtgggaaggtattaaaaatgtgttttttggttctatcaatgcgcttttgaattttgttcaactgtccttttttgggaagattcttgggattgcgaaatcactaggaaaagggcttttaggcatcttcccgaaaatgtggtctagcattgtcggtttctttaaaaatggtgctgcaaacaccggaaaaatggtcacttggcttaaagacaaagccgtttcaattgcaacaagcatgaaagacggcatgatcaaacgtttttgggacattgtagacgcagccaaaaaattgccgggtaaaatcggtaatggcattaaaagtatggcgtgggctgcgcttaaaggtgtcaagtcgcttgcggataaaatgaataacaaactatcctttgtcgtaaatggggtaataggtggcgttaactgggttcttggtaaagtcggtgttccgaaagaaaatcaaataccggaatggacaccgccaaaatacgcaaaagggacaggcggacacccaggaggacccgccattctaggcgacggaggaatgcaagaactgtttatcacgcctggcggtcaaatggggctgtctccttcaactgatacaatgatgaaccttccaaaaggaaccgaggtattgtcgggacctaaaacgaaagcgttatttgatgacgtaccattttacaaagatggtacaggcaagggcggtaacttcatttctagtctttttggtaaagtgaaagacctggtacttgatgtgtctgacttcattacaaagcctagcaagctaatgaatacattgcttcaaaaaatggggatcacgcccccgagtatggcagggggctttggtcagattgtcaaaggcagcttttcttttattaaggacaaagcggtttcctttattaaaaacaagatcaaagactttggttttgttcctggggagggaggcagcgcagcagttaaaaagtgggtcgcccaagcaattgcgataaagggaatttccccctctttttcaaaagcgcttgaaacgatcgccatgaaagaatcgggcggaaaccctacagtcgtaaataattgggacagcaacgcaaaagcggggcatccgtcccaagggcttatgcaattcattccgtctacttttgcagcgaacaaagaacctggttacggaaatattaaaaaccctgtacaccaggttattgcggctatcaactatttgaatagtcggtatggcggaattaacaagcacccgggcttggtcaacatgagaaaaggaggcaagtacattggctatgataaaggcggtatcattacccgaaatcatacggcagaggtccacaaaggggaaatgattttacctttaaggcaattcagaagaaaccgagccatgcaggtacttgctcaagctaatcgaatggtaggctatcagcccgagcagccgggacaaggttcaacaaatgtcattgttcaaaatgatagtgctgatgctattaagcaactagaaaacaagtttgatcaaatgatcggtttgttgacacagatcgccatgaaagacaccacgataaatgttgagggactaaacaagtacaatatggatttacttaaaaatagacagcgtaggggagggcttgcgacatgagttacgaattttatacggattacggggaagggcttcaattgatcagcgagcgtcttccctttttacgttgcgtaaaatttacgcctgtgtcggcttctatcgaacgtcaaacggcggttgtggcaaatagaccaggattaaaacaaacgtcgaaaaaagtccgttttaaagaaagaaaaatcaaagcacgattttatattaaagcaaaaagcacggatcagtttaatagatacagggcggcgctcacaagggagcttgtaagggaagaaccctattacattagttgttctttttcgcctggtatacgctacctggtgacgtgtgatgatgaaattgaaatcgaaaaagatgacgggaaaaattataaagaagttgatgtggaatttaccgcagcgcttgggcttggcgaaaccgtttttaatactgaaaaacccttgaatttaagtggtgaaaattttcatatcggcatgaatttgccgagtcaagatgatctgaaataccgtttcacatccaagacgttcaaagtctacaacgcttctgatgtgacaattgatccgattgactttgattatagcgtcaccatgtatttaacaggtaaggacgtgaagatacgtaatgatgccacaaaagaggcgttaacgataaggggatcggtttcgaaaaagcaaaaaatcattatcacacgtcaatatgtcatgattgatgggaaaatggcggacacgtccgggcgctttccgagtttgcgccctggttttaatctatttgagatcgaaggcgcatctagtattgatatgcggtttgccttgcgcttttactataagtaggtgaaatgatgaatcaattatttgtacagtcaaagcatgatccaacaaataaagtacctttggaacatgtagaacccgaagtctcggacaaattagacggcacaaagcaattgtcatttcaatgtttgcaaatgcccgagactgaaattgctttcgatatacttgtaaatgacaacattttgctaatagatgagattgagcataaagcgcagcgttatatcattgttgaggatgaaaagcgcacagaaaacggcgtgtcattccgaaatgtggtggctgatcatatgtatattgttcgtctgacatataaccaggtggatgaagaaattaacggagaaatagatatagacacagcgcttaaacacgtattaaaaggaagcggctttgcatatacgatcatgccggatgctaaaggcttgaaagccaaactagaaggattcggaaagaagaagtcgttagagctgatgaacgatcttatatcggcttttgttgttgaacttgatgtaaataatgatcatatttacgtattcaaagaaatcaaaaagcggatcaattacaaattagataccagggcgaatatgaatacgattagtgttaaaagcagcttgtccgagtcttacacacgaataaagggttatggaaaggtgaaggaagaaaaggacacagcaagcgaggaaacaaaaagctatgatagtaaatcgtcgaaatggaaaacaaacagtgatttaaatgccatgtatgcggaggacgttggacaaacgttctcttttacgtttaaagggacaggcttcagcgtgaagctgatcaaagaaaaattaggcgggaaaatcacgttcaatatagataaaaagacaaacaaaacattcagcacgtacaaagacacaggcaaagaaagtcatgtggttgaaacggttgatgtgatccggggtcttgaggataaagagcatacggtcgttgctacattcaaaggaaaagatagcaaaaacccgaacacgaaaaaaatgaaaacgggtttccgtgtgagcgtgcctaacgggaattttattggactttatcggacctttaaaaatgatgaaaagtacatgttcccgcctgtaacttatattcaccccgacgaaaaacttttccttgtagatggtcgcccgagagtagcggaaacagtttacgaggattccatttcaaaaaaagaggacatggaaaaatttttggaaaagaaagttgacccttatccaaaattaacgatcgaattggattttgaaaaagtatatgatccgaaactcgaagcgattgaggacaacatttgtaaaggtgctattgttccagtcattgcagatacagcatacggcatcctgtttgaaggagaggtaagggtacaggaaatcaaatacaaccctctcaatttggatatgaagccgtctgtcacgctgacgaattatcgtaaagacattattgactatcaactagagcagaccgtcgcaatgaagaagcaacgggatttaatcaagaaagaaatagccgaaatgcttgaggcgcaaaaaagcatagcaagcagcacgcaaagccaattgaacaatattaatacaaaggtttcccaggacttgagcttatcgtattcaaccgtcacgaaaacttggtcaattgatgatagcagcgttgatggtgcggaaattgacgagatagggaacaccattgatatagatgttgggatcgacataaaaccaaaaagccccagggcgggcgttgattttgatttaagtctaaaggggatcacggcaggcgcaaccattgatacgaccaacccaagcgccatgaatattgtgcttgctaaagacggtcaaaggatcagcccaacggctgccgatataccaaacggcgcacaaattaatatttcattttacttagatagctgacgatcaaacgtcggctattttttatgaaaggagctgatagcatgggaaggttcaatttattgaaagtctttaaaattggcagaaatgcagagtttgaagacaacctatcgcaaaatgcaagatcaatagaaaacgctttgaaccaactagacatagaaatcaaagaacataaagggagcgaaaaagctcacgaagcggcaagcatcgtccacagagggaaaagcgttgcacactggctcaatagttattggtcccgtcttgttaatctgatcgtcaatcatgatggcaacgatataaaagaagttgtggacggaagggtttcgcttgatgcgaccattcatccgactttgaatgatcgtcttgaatatgactttgatcagcttgaaaagaaagtgaatgacatgctttcggttgtgtctttgcagccgtttttaaacaaatacggcaacttcacaaaggctttacaagcagcgttagaaatagcaaaagatcgccccatttggctttatattcccccagggggctatacgctgcgggaacgggtgaggatttacaaaaacactcatattactttacaggcaggggcaacgatcaagcgtggctttgttggcagcatgtttgtaaatggtgattcaaatgagagtttcaccgggtacaacgggcacggcaacttgatcattgacggacaaggaacaatcgacagcatgggacacgagatcaagcaacagtgttctatttttgggttcgctcatgcatccggcattatcatgcgagatctcacattgagaaatgtttgtgggggacacgctcttgattgtgcgggcaatgaaaacgtgatgatcgacaatgtgacattcgaagggtttgcggactatgtaggggacagatggttttccgcagcggttcaagttgatttgatgagatcatccggcaattttggcgcttttggagcttatgatcacacaccgacaagaaaccttacaatgaaaaattgtactatccgtaaatcagcagagcttgggggctatccgagagcgattgattcacatacaagcactgacggcgtcctatactcgggcataaggtttattaacaataaggtctatgactgtacagaatgggcggtatcgggcaacaaatggcaagatgtgttcattgatggcaattcctttgaaaactgttcaggtggcgttagaacgttattgcctggaccaaacagcgtttatacacaggataaaaacggaaatcaaacagggcgtgttaataagacaaagcgtcacacaattacaaacaacaaatttaaaaacatgtcggctgaccatgcaatccaggtttacggtcgtaaagggtatcaaaccattgatcttgtggtcatttcaaaaaatcaaattgacggcacaaccaggcacggtatccatgtttcagatgtaaagcattttgttattgatgataatatcctagaaaatatcgggcatcatggcattttagttacccgcagcactcggggaaaagttcaccacaacacaggacgagaaattcaaggaaacggtgtgcgaatcgaggagggaagttgcgattttgtttctgtggatgataacacgctagaagaaatcgggttttcgggaatatccgtctcgggtgattctgattacgtacaggtagatgaaaacacgatcatgaatgcgggcaagcgtggtgatgattacgattttattttatttatggatggcgtgaaaaatagcgccgttcgtaataatacagcaattgggaaaacgggaaggtacggtatgtatttaacaagcaaatgttcagctattcagcattacggtaaccgattaaaaggagccggaaaagtatctgcattaaacgataaaagcgttgatcctattcgtaccgttgaaaatatcacttgaggggggataacatgacgaatcaactttttaaaaatggcgtgctgcctttcgtggttgatgcctatgatcaaagcgtgtacgattcaaaaattattttctcaacccaggacataggcacagcaaagctaattttcaaattgcgtaaagatggcgtgcctttgcctctttcagcggttgacggaaaactcatactatcattcaacaatggatccaagaacgttcggaatatcacacttgttgataaagtagaagggattgccgaatacgtcttagacaataacgagattaagctatacggtaaggtccaagcgtcattaaatttgtattatcgtaacggacaagccttgtcgattcacgaatttacatttgagattcagcgcaatttaattgaccaggacattgccccagcagcggaattttatattgatgattttcattctcttaaaatcgaaatagaacgtaaagcagcgcagcttgaagcggatataaaaaagcgaactgacgatatgcaaggaaacattgataagatcaccaaagagcttcaagagcagcttgacaggatgaaagagaaacttgacgatctcgaagcgcttgaaaccaaacaaggcgcacaaggtaaagtagacgcagcgcttgcagcggctaaaaagtatacggaggattacgcagagacacccgcaaaggctcaagaaaaagcagatgaagtcttgaagaaggcgaaagactttgtctcgggttttcaacaaaagaaaattacggctgatacaggaatgccgttgatctctctaaaagatacatccaagagcattcttgaggaaattatcaataatggagtagggcaaggaactttttacgcaattgccagttcaaaagatttaccgaatcagcgttctttccgaggtttctatcatatgactgattccacgaacggcgtcgcctctttcggatgggtatacgcaaccgactatgtaaataacgtctacacaaactatttaaataataatgtatggagtggttggtcaaggttgtctaatcacaatttgctgtctgaaaccggacaaagccagttgcttccgaacggtacggacattttaacactgccttccggttgttattatgccgttggaacaaatgtcgtgaatatgccgagtaaaaccgattcatcttggttcaatatttatataattgataacggcaacaaccgaaaaacgttccatattatccgaagtggagataatctccattggtggggaacgactcatacggacggatcgttcagaggatggaaacggatgctgacggatgatgattcaagtggaacatggaaccaagtaacgttaatcgctggaacatcaacaaaacaatttgcaggaaatccactcaaattttcaattcgtcaaaatgatttactacttagggggtcttttgagggagtcccggcaaatgacgcagtcattgcccgttttactcaaaaaccgccaacaaaagccgtgtttctcggtgcgacggtgggttcttatggttctgctagatttacacttgatacagacggcgctttacgttttgacgggatgtccgctaacgataattcttttgtaagtagatttgaaataaatgaatgtatcccattgttttaggaggtaattacatgcacatttattactatgatgagaagtttaaatatcaaggtgaagatgtaattgattatgacgagctgccgaaaaatgctacggatgcaagaccgcaagaggggttgtatcttcccgagtatgacgagaaaaaaagagtgtggtttgaatcagcatctaaagagtatatagagagcttacaaccaaagccgcagccgtcaaaaatagacctcatggagaaacaagttgccgagctttattacttgtttgcattagggggtgatccatcgtgagtgatttcgattggttcagcagaatcaaagatttttatgatagagaattatggtcaaaagaaatggtttataacactgtagcagcggggagaatcacacacgaacaatatgaggaaatcacaggtgagccgtacgaagtataggcttattttttatgtttatggcgggagaaggtgagagtgatggaaatggatattgcgcagtatttaatgacacaaggaccgtttgcggttttgttttgttgggtgttgttttatgtcctcaatacaactaaagagcgtgagaacaagctaaacgagcaaatagacgcacaaaatgacatattagcaaaattcagtgagaaatacgacgttgtaatctcgaaattggaccgtattgaaagaaaccaaaaacaataagaaaagaggaatttttgatatgaaaaactttgacaaaggcacggtcgttcgcacggtgcttctttttattgcactaatcaaccaggcgctaatcatgtttggcaaacctgttttgccgatcagtgaggaccaggtaaacacattaacagaaactttataccttgccttctcaatggtctttacgttagtgacaacccttgtcgcatggttcaaaaataactatgtgacaagtcgagggaaagcccaaaaagaagcgctgcaacaaaaaggattaacaaaataaagggctgccccaggcagttcttttttaatacctaaaataattttaagggagtagatgaacaatggtaaaaatcattcaagactatatttcaaagagtaaccgcaacagaccaggcaactatatgaagcctttatatattacagttcataacacgtctaacacgtcaaagggcgcagacgcagcaagtcacgctagttttgtgaaacgttcatccacggcggtgagctggcattacactgtggacgaaaatgtaatctatcagcacttaccactaaacgaaaacggatggcacgcaggagatggcagaggaacgggcaacatgaagtcaatcggcatcgaaatttgtgaaaatgcagatggtaattttgagaaggcggtagagaatgctcaatggttgattcgccaattaatgacggatcaaggcattccattgtcaaacgttgtaccgcataagcattggagtgggaaagaatgtccccgcaggttgcttgatcgttgggacagcttcaaaggcggtatcgccgttgctcacataaataaaaagccgtctgctaaaccaacaaaagcaacaccatccaaaacagcggcttccaagcctgctaaaaagtcatatggtttgccagcaggcattttaaaagttacaaagcctcttacaaagggatcagcagtaaaagccgtacagcaagccctagcggcggtttactactacccggacaaaggagcaaaaaacaacggtgttgatggctattacggaccgaaaacagcggatgcggtcaagcgattccaattgatgcatggacttgctgctgacggcctttatggtccaaagactaaagcagctttagaaaagctattaaaataaaaatctatagacttatgactatagatagttttaaaacaagaaacccccctgtccattattggatggggggttttacttatatagaatttattttaatcttccccatatagctcttccgcctgtatgtcctgttttcttgtgaatttctttgttcacaagttgtaatcttcctgtgttttcatggtgatgccaaacatagcctctaggggttttgttatggtttatatcaatgatttggttcttagtaaattttttagcatgtttaggtgacttaataccgatttttaaagatgcgttcgccttagcgaattgagttttgttagatgactttattaacaaacctggtagattgtaattgaattttgaattgaaaacagggaagccatttgcagtgaatttaacaccggttttagggtgtttctttttagcaagttttccatttctgattacaacttttttcgttgagtttttcaaatattgttttgcatatagtttcccaccgattcgcataacaacaggaaaagcaagaggaactaaccaaaaagggtaagcttgaataatatcaacgtcatcgtctgtaccaattgcatcggctggagcagaaaacgatggttctactaattcccctttttcaaaaacatcatcagaaattgtatctttttctagctcctcatctgtaacatcatcttcaagtaaaccttgatactcttcatagttatcccaatcctcatattcttgagcatatggaaaatcatcatagttttcgtaagaagattcaatgtagtcgtttaattgatcttccgttaaattactttctctaacttgtgctgattccgcttttgcaaactccggtaaaataaaagatactagaagcaatagcggtaatgttgtacataaaaacttccttaatttcaattaaagcacctcttttgtattatatttacaaacattgcaagtataatacaagtattggaggtaaacaatacctattctataaaatcttccaattgattaacaataatctcaacatctgaatcatttaatctatttaagttactaatgatacttttaaatgtttccagtgattctttgttctctaaaatcaagtttttcttgtatgttgctactgtatctagcactaaccccaattcaagagcgccatcaacgtcattcgttgaatgagtatgagtttctatttttttcaataaccaaatgagatcgtcataattttgaatagggaagagcttgagattagaaaataattcttcattatttttttcaaatatcctatttacttcatcctttgtaattgcgtctggatcgtcgggcgatatatatgtaagttcatagtcctcggggtctaacccttctaaatcaggttcactatcatctgattcatcaatatagagttttgaaataaattcattaaaactatctgctattttaaagtcctcttctgtttctaaatcgaaaaaatgaacgggtggattctctatggtatttcggtaatccagtgcgacccaggaatgaccatcacccgagataagaataatatctttaggaagcccccattcttttattaaatagtcactttctaaaatcccttctttttttccgatccctagcaaatgatcaaattgtatatgatcctctgcccaggaagtaggtctatccgtagggaaagcattacattctaaataaccgccattttgctccaagactaagtttttatattcttgtggcagcttaactcctagctttttttctgttttcagaatatctttttcagatattttttttaaagtatatggatcgtctgattggttagcccaaaattgtttcaactcatcatctcctaaaatatagatatacttttaaattataccttcgactcaaagtcttatcaatagacttaaaaaactaaaagaatgaaaaaaattgcggtttgttttcggtgtggaaatatttcaaaaatgataatatatgtaattatagggaatagcaaggaaggggtagggtcttatggagaaagttctttcttctcatgtcgggttgaaaatcaatgaatggtattaccatattcaaagatttaacgtgccggatgccgaagcatataaagaagaaataaaatctttgctcgatgatatggaggaaaaccaggatttattattatatttctctctcatggaattccgacataaattaatgttggattatttgaatccattggaaaatggaaaagagcgtgccgactttagagagttagcaatgaagatcaaaaaggatcaagagaaattaacgggtttacttgattattattttaactttttctatggcatgtacgaatttgaaaactatgaatacctcaacgcaattaccttctataaacgagcagaaaagaagttatccttagtaagtgacgatattgaacgagccgagtttaatttcaagatagcggaaatctattaccacatgaaacaaaaccacatgtctatgcaccatatagcccaagcaatagattgttacaaagaaaaaaacacttatactgttaggcagatacagtgttcttttgttattggattaaattatattgatatgggttgccccgaaaaagcaatgcctcattttgaatacgcactagaaaaatcttccgacaacgcaacaaaaagattaaaaggatcggcgctttataatataggattaagttatttccacaatgatgaactattaatggctataaaatactttaacgaatcaatccattcatttaaagaacaaggatacgaacatttaaataaaattcttgatccgatggttatgttgacaaagtcatactttaaaactgatcaaaatgacttagggttatacgccttaaacgagggaatagaattggctggaaaattgaaagacgacatatttataaatacattcactctattgagatcattgtatttagaaaacaatgttagtcttttaaaagaagcaatggcttatttagaatcaaaatttctttatgcgaatcttgaagatttatcgaaagatgcggcgaagcattataataaggcaggagataaagagcgtgcaaacgaattttatgagaagattctttatttccaactccaaattaagagaggggactgtctttatgaaatttaagtcagtagcagccgtattaattattgtaagtttgttaggtgcttttagttatgtttcatcaaacgatatccataatgaagcccaacggggacatacaacaagtattggttattttgcttaattaaaaaagcccttttcgggggcttctttttatttgaaccgccattccttcttttccttatcccatgtcaattcatttcttgttaacggcttttcgtatagattgttcgtctttacctgtttttatttttaagtcctccattgtggggttcttgcggaatctgctcatattatatatgatcctgtatagcttcctctcaagatcattcatgaaatcaccaccgtgacctattttatttgaatatctttttcattagcttgccgcttgctttacccgcagcacgtcgcatgatacgtttttcgatagtacccttttgaacggcattgacgtcacccaggtattttgatgtcttataaaggaatgatcttattttgtttatgttcatggggtatgcacctactttcttcattaatatagagttatgtgggcttgcccactaaatgcccactaattgatgacaaactataaagtggtatgatgtaagaataatataaaacgcaggaaagacaacaacaagggaatatatgttcttgtgtgatttcctgcaaataattttttcttctaatagcatcatgatataagctgggaacttctcttcggcaatctccatgtagcgctcaatcatgacgtaatcatcactaatgtattgagacagtagctcgtaccaccattcagtttcgtagcgggcaatcatactaaggttatacattaataagtaatggctgatgacctcaggaatccctaaaaaggaatcacgcgttgacggaatataccattgatccatttctaaatcataatgaagatgagtggcgagcgctggattttcttctagtgatacatcaaatgtcagctttttcgcttctctctgtctgagtttccaacttgtatgaaactcaaaatattcaataaagcgttcagcagacatgttataaagcaatggaatatgatcttgaatcatcatcccattggccttttccaccttaactaatgtagagggctgtttttgaaactctagaatatgactcatttccggtatctttgaaaggagatgaatcatcgtaaatcgctcatcttcaagtccatttaaatgaaatagatgctttaacacatgcatgcatagtccatttcgctgaattttcacctcatcttcactaaaacggtaatgctgcttctttctctttctcgatgttacaccatgcgctaaaacagaggtttgagaaggatagtgagggtcaactgtcagtaaacatgcctttagcaactgagccattccataaaacaataaaatgggcttcagttcgagtggagcgatagctgcctgttcatagaacgtatgaccatgctttaaaaaataaataaaccgttcacagtttttataggcttgctggtttgcatcttgaatgctctgtttctcatattgttgatatagaaacttttgggaagtttcgagtgagtaaaaacgttttaaatccttccatcctgaacttttcatcttcttcctcaactctctttatattttctaaaaattgcaactgtttgttgcttccttgacatgctgtttgctagttgataatctacatataatattttgccgaaaagagggggatttactaatgtgggaaagtaaattttcaaaagaaggtttgacgtttgacgatgttttgcttgttccagctaagtctgaagtacttccgcgagatgtcgatttatcagttgagttaacaagcacattaaaactaaacattccaattatcagtgcaggaatggacacggtgactgaatcacaaatggcgattgcaatggcacgtcaaggtggtcttggtatcattcataagaacatgtctattgagcaacaagcagagcaagtggataaagtaaaacgttcagagcgtggcgttattacaaatccattcttcttaacacctgagcatcaagtatttgatgcagagcacctaatgggtaagtaccgtatttcaggtgtaccaatcgtaaataacatagaagatcaaaagcttgtcggtattattacgaaccgtgaccttcgatttatttcggattattcaatgaagattagcgatgtgatgacaaaagaggaacttgtgacagcttctgtaggtacgacgctagaagaagctgaaaaaattctacagcaatataaaattgaaaaattacctcttttagatgacgaaggaacgttaaaaggtctcatcaccatcaaagatattgaaaaagtgatcgaattccctaactcctctaaagatgcacatggccgtttaattgttggtgccgctgttggtgtcactggcgatacaatgactcgtgtaagaaaattagtcgaagccaatgtggatgtcgttgtcattgatacggcacatggtcattcacaaggtgttctaaacactgtatcgaaaatccgtgaaacatatccttctcttaatatcattgctggtaatgttgcaacagccgaagcaactaaagcattgtttgaagcaggagcagatattgtgaaagtcggtatcggaccaggatctatttgtacaacacgtgttgttgcaggcgttggtgtaccacaaatcacagcgatctatgattgtgcaacagaagcaagaaaacacggtaaagctattattgcagatggtggaattaaatattcaggtgatatcgtaaaagctctagcatctggtggacatgctgtaatgcttggaagccttctagctggtacatctgaaagcccaggagacacagaaattttccaaggtagacgcttcaaagtatatcgcggtatgggctcagtcgctgcaatggaaaaaggaagtaaagatcgttacttccaagaagataataaaaaattcgttccagaaggtattgaaggccgtacaccatacaaaggaccagttgttgatacagtgtatcaactcgttggcggtatccgctctggtatgggctattgtggaacacaggacttacgctctcttagagaagatgcacagttcattcgaatgactggtgcagggcttcgtgagagtcatccacatgatgtacaaattacaaaagaatcaccaaactacacaatttcttgataaattgtgacaatcaaattacatttgacagggtctatgactctgtctattttttttgtctttattgtgataaaatttatactgttgtgttgaaataagcccttgtggattaaatatatatgaaatatgtcgaaaaagatgataacggaggtatgacgattgaacagcaagatattgaaacagcttatggtctctatccttgcattggcattgattgtgacagcatttacaccaatgtccaaagcaaaagcagctgaagatccattcaatgtgaatgcgaaagcagcgatcctaattgaagcttctacaggtaagatcctttatagtaagaacgcagaacaaagactgcctattgcaagtatggcaaagatgatgacagagtatctattactagaggcgattgctgaaggcaaagtgaaatgggatcaaacgtatacgccagatgattatgtatacgaaatttctcaggaccgcagtttatctaatgttcctttgagaaaagatggctcgtatacagtgaaagaactttatcaagcaacggctatttattcggcaaatgcagcagcaattggcttagcagaagtgattgctggatcagaatcgaagttcgttgaaaaaatgaatgcaaaagcgaaagaactaggtttaacaaattacaaattcgtgaatgcaactggactagaaaataaagacttacatggcaaacagccaaagggtacaggtcctgatgaagaaagtgaagtatctgcgaaagatatggcattgcttgcacagcatctcatcaaagaccatccagaaatccttgaaacatcaagtattgcgaaaacaaagttcagagaaggcacagacgatgaaatggacatgcctaactggaacttcatgcttaaaggacttgtgaaggaatatgaaggtgtagacggcttaaagacaggttctacagattcagctggttctagcttcacaggtaccgctaaacaaggtgacatgcgtgtcatcgcagtgatcttgaatgcaaaaggtaatcttcatacagcacggttcgacgtggcgaaaaaactgttcgattatgcgtttaaaaacttcacgatgaaagaaatgtacaaaaaaggtcaacagatcaaaggacatgaaaacatcgaagtcgacaaaggcaaagacaaagaagtacctgtcgttacgaaagaagctttctctgtgccagtcaaaaatggcgacgaaaagagcttcaaagcaaaagtaaatatcgagaaaacgaaactagaagctcctatgaaaaaaggaacgaaggttggcatgctgacgacttcttattcaggtgatgagaaggactacggctatttgaataaagatcaatcaggtgttgagcttataacgaaaacaggcgatgaaaaagcaaactggttcatccttgcaatgcgtagtgtaggtggattcttcgctggcatttggggcggaatcgttgacacagtaaaaggttggttctaataaaaactgctctctatatatgagagcagttttttatcgttaaaagaaaagcgattgtttgtgattttgaggagtggacaaggcttgctgaaaaataccacataatttttccacgccttcagatagcgctttttcattcacataagaaaagctgaggcggatatagttttgcttcggctccccaggatagcacacagagccaggcagaaaggtgatttgctgtttgcgtgcctcatgcagcagtgcacgtgtatcaacccaggaaggaaagctaagccataaattgagcccaccctgagggatttgccacgtcacatcttttggtgcatgcttcgttaacacatctatcattaaatcacgtctcaccttcaaggcggttcgtagcttttttgtatgatcaatcattttctttgaagtcagaaatggcagaatggctttttgtgtgagaagagggctgcctaaatcattattggcctttgcagctaataaacgattaaatatcgagcctgaagcagtaataatcccaattctgcatcctggagcaagtgttttacttaaaccgcgtaaataaatgacatgtccatcatgatccagacttttaataggtgcaggcggcttcttttcgaaatatagctcacgataaggatcatcctctacaatgagacaatcaatactttgagccagtaagagaagttgttttctgcgtttcattgacatacttgcgcctgtcggactgtgaaaagtaggaatcgtgtagatgagctttggtttatacttatcacaaatgctttgaagctgcttcatgttcattccttcatgatcaacagggactgtaataattcttgcccctctacccataaagacatcaatggcacctggataggttggtgcttccatgacaactacatcatcaggaccgataaacgcacgtgcgaccaaatcaagtccttgctgagaaccactagttactaagatattctcaggagtagatggcacatccaacttttctaaaaaagactgaatgacttgccgaagctgaagatccccttgaatttccccatacttagacatgatttgaggatgtctggctaggacatgctgcatttccttttctaaataccggtttggcaaaagccctggatcgatcatagaggaagaaaggttgatcgcttcttcgacatagtgatactgagcaaattgagatcgtggtaaataatccggaatggataactgccagtcaaaagaggtagatgacggaaccggaacatctgactgcttttgcagctcatccacaaacgtaccttttccttgcacagtcgttaaatatccgtcgtccttcagccgagtgtatgcctttgctgccgtgacaagactcacattcagctgctttgctaaatcacgaacagttggcagcttatctccttgttgaagcaaacccgattggatatgatcaatgattgaaaagtaaatctgatttgaaagcgatgtatcagaatgtcgatggatatcaatatgcatgagaaacctccattgagtgcaaaattgttatacatggatttgaattgttatagttgtattatagcatgtaaatgacacttcaaagaaagaatgacatatttttagcaggtaatcgtttatatacaagggtttaagcttttttttcggctgattgaattgttatactattctctttattgttatactgtctcgcttgtatgataaaggggtaaatcaatcgaattgacaaatgggaggaaactattgtgagcaataagggaactgaacgagtgaaacgtggaatggcagaaatgcaaaagggtggcgtcattatggatgtcgtcaatgctgaacaggcaaagattgcagaagaagcaggtgcggtggcagttatggcactagaacgcgtaccagctgatatccgtgcagccggcggtgttgcccgtatggcagacccaagaatcgtagaagaagtacaaaatgcagtaacgattccagtcatggcaaaagctcgtatcggccatatcgtcgaggctcgtgttcttgaagcacttggtgttgattatattgatgagagtgaagtgctgacgcccgcagatgaggagttccatttaaataaaaatgaatacacagtacctttcgtttgtggttgccgtgatttaggtgaagcaacccgtcgtattgcagaaggcgcttctatgcttcgtacaaaaggagagcctgggacaggcaacattgtagaagctgtccgtcatatgagaaaggtcaatgctcaaattcgtaaagtagcagcaatgagtgaagatgaattgatgacagaagcgaagaacctaggagcaccgtatgaattattgcttcaaatcaaaaaagacggcaagctcccagttgttaactttgcagcgggaggcgttgcgacaccagcagatgctgcgttaatgatgcagcttggagcagacggtgtatttgttggatctggtatttttaaatcagacaatccagcgaaatttgcaaaagccattgttgaagcaacgactcacttcacagattaccgtctcattgcagaactttcaaaagagcttggaacagccatgaaaggaattgaaatctcaaatctactgccagaagagcgtatgcaagagcgtggctggtaattaagggagcggcaaacgaacatgctaacaattggtgtactagggcttcaaggagccgtgagagagcatattcaatcgattgaagcctgtggcgcagaagggaagatcatcaaacgagcagaagagctagcatctgttgacggtcttattattcctggtggagaaagtacgacgatgagaagactcatggatacgtaccaattcattgaaccgatcaaatcgttcgctgcagaagggaaaccgatcttcggaacatgtgccggtttgattatgctggcaacgcaaatagaagatcgagacgatgcccatcttggactgttacatgtatctgttgcacggaattcatttggcagacaggtagacagctttgaagcagatttagaagtaaaaggactggatgcgccatttacaggagtgttcatccgtgcgcctcatattatcagcgcagatgagagcgtagacatcatggccgaatatgatggcaggattgtgatggcgaaggaaaacaatatcttaggctgttcttttcatccagagctgacagacgaccaccggttaacacagctgtttgttgaaatggtgaagtcctataaaacgaagctcgctgtataaaacggttgaaaagagataaaacttatagtacattaaaatcacaatcaaagatcgaaaaagcgttgacgggaaatagtaagaagcccctctttctcagagagccgatggttggtgcgaatcggtgaaagatgcagtctgaatccatccttgagcgaaatgctgaaacacgaaaagtaagcatttacggtgataccgttacagaggaaagaggaaagcatgcttctgcatgttttcaatcagggtggcaacgcgagagctctcgtccctttcatgggatgagggctctttttatttttcgataaaaaaaggagtgttacacatgctggatattaaacaactgcgcacggactttgatcaaatcaaagaaaaattagcacaccgaggcgaagatttagcagattttgataagtttggtgagctggatcaaaaaagaagagaactaatcgggaaaacagaagaattaaagagccgaagaaatgaagtatcacagcaagtggctgttctaaaaagagaaaagaaagacgccgatcacattattcaagaaatgcgtgaggtaggagatgagattaagaagctggatgatgagctaagaacagtagaagaaagcttgcagcacatcttattctctattccgaatatccctcatgacactgtacccgttggggaaacagaagatgacaacgtggaagtgagaaaatggggcgaacagcctgcattctcatttgagccaaagccacattgggacgtagcggatgaactaaacattctcgattttgaacgtgcaggaaaagtcacaggaagccgtttcgttttttataaagggcttggcgcacgcttagagcgcgcactatacaactttatgctcgatttgcacgtagatgagtttggttttactgaagtgcttccaccttacatggtcaatagagcaagcatgacagggactggacagcttccaaaattcgaagaggatgcctttaaaatccgtgaagaagattatttcctcattccaacagctgaagtacctattaccaacatgcaccgtgatgaaattcttgaaggggaacagctgccaatcaattatgcagcattcagtgcttgctttagatcagaggctggatctgccggcagagatacacgcggacttatccgtcagcatcaatttaataaggtagagcttgtgaaatttgtaagacctgaagattcttatgaagaattagagaaactaacaaaccaagcagaaaaagtccttcagctattaaacctgccataccgtgtcatgagcatgtgtaccggagatttaggcttcacggctgcgaagaaatacgacatcgaagtatggattccgagccaagatacgtatcgtgaaatttcttcttgcagtaacttcgaagcgttccaagcaagacgtgcaaacattcgattccgtccagagcctaaagccaagccagaacatgtgcacacattaaatggatctggtttagcagtaggaagaaccgtggcggccattttagaaaactatcaacaagaggacggtactgtgattattcctgaagtactgcgtccttatatgggaaataaagaagtaattaaataagatgccgctatggcatcttatttctttttcccaaaagtcctacagttttcctaaatttagccgatagaaatactaaaagcttctaggaaagaaggaataaccttgaataggcttgactattatgttgaaatggctcaattagttaggaaagttctagatgaaagtatccttttcggcatcactgatacagagaaggtgctttgttactatccgtctaacacaatagattttggcatgaaggttggagacccattgaacccagaagaccaaaacgtggcgacgacattaagaggacaagaatatgacggtcatttaccagagtctttatatggttatgaaattgcagtaaaaggttacccgatttttgatgaaaatagaaaagtaattggctcttttttagtggcattttcacatcatcgtgaaaagaaactaagtggttatatggaacatattaatgatgtagcgaaagaacttcaaagtgggatcgagcaaattgctgcgcattcacaagagctggcagccacaagtttagaaataagcgaacaggcaggaagagcggaagagaaatccgcaaatattgaagaagtcgtcaaaaccattggcgggattgctagacaaaccaacttgctaggcctaaatgctgcaattgaagcagcaagagcaggtgagaatggaaaaggatttgctgtcgtagctgatgaagttcgtaaattatcagatggctcaaaggaagcggctgaaaccattaataccttcttaaaagagatccaagacagcattggcactttgtctgaaaacatctcacaaatcagcagctcaacaaatgaacaagccaaacaagtgacagactttacgaaaattatcgaatcattaaatgagtttaaagaagagatgaatcattttattgaagagattagacaggatacaaaatagatcaagagcagccgtcgatggctgcttttttatgggcagattctcatgccaaaataacttattgaaatttttttcgaaaagatgttgacttcaaataaatcgatatggtatattaattcttgtcgatacggaggaatacccaagtccggctgaagggatcggtcttgaaaaccgacaggggtgtcaaagcccgcgggggttcgaatccctcttcctccgccatattgattttttaccttagttgaattgaaacgcaagcataaaaattggaattgtcaaaccgctgcattcgcgaaatgcagcggttttttttattttgttttagagcgatttttttgtataacagaagctatttcatgaagaatgggctcaagtgagctttcatcatgaagtaagtcgtaatcttcaatgttaattttaatcactggacataaatcgaattgttcgatccattccgtgtatcgcgtgtacatttcctcccaataggctcgatccgtttgagtttccatctctctgccgcgttcctcaatacgatgtaaaatatgatctaaatccccgtgtaaatagataagaacatcagggtgagggaagtaaggtgtcatcaccatcgcatcgaatagactcgtatacgtttcataatctacttcagacatcgtacctttgtccgcatgcatttttgcgaaaatgcccgtgtcctcataaattgaacgatcttgcacatatcctccaccagattcaaaaatccgcttttgctccttaaaacgctcagcgaggaaataaacttgtaaatggaagctccatctttggaaatctgaataaaagggctctaagtatgggttatcatctactttttcaagagaggtttgaaagccgagcttgtccgctattgttttagtcatagttgattttccgacaccaacagtcccggcgattgtgatcactgcatcctttggtatttcgatattgttcatagcacttgctcctttatgttctgtacaatttgctggtaatcttgctgcgaggaaacgaagtctgtatgatctccttcaattgtaatgataggaagccctgggtcagtctgttttaaatgttcaatggccagctcataatcttcaatgagtgtttttaaataagccgggtcaatgtcttcttcaaaagagcgtcctctcatctgtattctttcaagtaaggtaggaaggctcgcttttatatagatgatggcatttggtttaggaagatcatctgttagcaggtgatagatctttctgtatttgtccatgtgcttttttgataatgttctttctgcaaatatcatatttttatagacatgataatcagtgacaatcggctgctgttgattcacataggtttcttgaagagattctaattgtttgaaccgattgcataaaaagaacatttcaagctgaaagctccattgttccatatcttcataaaatttatctaagaatggattttcttctacaatctcttttactaaaggaaattgaaattccttcgcaagcattgtagccaaagttgtttttccggctccaatcgggccttccactgcaataaaaggggcaggatacataggcgttctcctctatctataaagttgtcaaaccaatgtatattgtaccatacccctcccgagagatagagcgaacggattacgatgtcgttcttttttcaatattaaattgatctgataataagagccaattttgaggaaaggatagacctaatttccaataagcaattccgttcaagtttaactctttgatgaggttgaactttgcttgaattgatctagcatcttcgaaccatacctcatgctctttattattggcatctgtataacggaaataaggtgcttgtgctgtttcgtcatatagaatggaggcattattatttctagcaattgcaatcgcttgttggggactgacagctttagcaatcggaccgccttgaacgtaaggaagcgtccaatcatagccgtataagttctggcccataacaattttattagctggaataacggtcagtgcatattcaatgacttggcggacaggtccaatgggagagactgcttgcgcagggccgccgctgtatccccattcgtaggtcattaatacaacatgatcgacgatcttcccaatggcttcatagtcatgagcttcataccatttccccttttgctgactactggttttaggggcaagtgcaacagatattgtccatccttcttgatggaagcgggttgttgcctctcttaaaaattgaatgtaggcatctttatcagcgggacgtaaatattcaaaatcaaaatggatttcttttaattgatatttttttgcaacacgaacgatttcatttaaaaatgtggctttgacagattggttattcaaaagaatttgcccaagttcatcactgaatttatcattctctaggttagtcaccaccatggataaaacggttctgctctgagcggctatttgaggtagctgatctaacggtggttctttcagtgttccatctctttgcgcttgaaaactaaaggcgcctaaatgcgttaaatatggagaggcctctctagctgcttgttttaagttttcactgacttgatttcctcgtggttcaatgtaagcattcgaattaatgttccttttaggtctttgaggaatatagagcaagaagcgaataggaagtatcgcttcaggccgtattctattcacacgtgccaactcttccactgaaatttgaaatcgtcttccaatttgataaagtgtgtcattttgtttgacctcataaaattgtcctctaattggaatgacaattgtttgtccaatgacgagttgatttggtgtttcaatatcgttggtacggatgatttcattgactgttgttttaaaacgcatggcaatttcgtttaaagtatctcctcttttgacaacataaatttgaatagtcaacgccccctttgttattgctaacaatttatgagggttatggataaatcatgtttgattttcattcgtgatctctttagcagtggtgatttttgctagtagaacgttctccatcatcgttaaagcatattcgttgtctctattgtcatttgatgcgatacaatctttaggtacaattaagttgtattctcgcatgtatgcgtcatttgcagtgaacagaacgcaaatgtttcctgcaattccggtcaaaatgatgtcgtgtacacctaattcatttaagagtgtctctaatgcagttccatagaaggcagaatgcttcggtttaattaagaagtaatcatctttagatggtgccattctctctaaaataagggcgcttctttcgttcttgcatgtttccatcacagcttgaatatcagccttccagagaccatagtggtcgttgatatagatgatcggccaattttccttgaaagcatgatctttaagagctaaaatcttattggtcatttgctctgttttatcagcgagcacatgtcccatttcaaaatcaaaattattaatcatgtcgataataagcagtgccttttggtgcttttgcaaagtaagaccccctttaaaagattgtgctaatatgttaacctcaatatccttttaaaaaacatgaaaagagagccgtgctatgacgagagatgaacagtttatgcaagaagctatttctgaagccttaaaagcagaacaaataggagaagtaccaatcggtgccatcatcgttttagatgaccaaattgtgagccgtgctcataatttaagggaaacagagcagcgttcaattgcacatgcagaattacttgctattgatgaagcgtgtaaaacgactggaagctggcgtttagaagatgctgtactttatgtgacgcttgaaccatgccctatgtgtgcgggagcgattgtcctttctagagtgaaaaaggtcgttttcggtgcatacgatccaaaaggtggatgtgcaggtactttaatgaatttactggatgatgaacggttcaatcatcagtctgaagtcattggtggtgtacttgaaaatgagtgtggtgagctgttaagtcagttcttccgaaatctccgtcagcgaaagaaacaagctaaaagtaaatgaatggatgtcgtttgcaatttcgactataagaaggtatacttatgtctgcgtcactaacaatttaatattcattttgccgtgctaagcggggaggtagcggtgccctgtactcgcaatccgctctagcgaggccgaatcccttctcaaggttcgtttacttcaaggtctgccttaaataagtggtgttgacgtctgggtcctgcgcaatgggaattcatgaaccatgtcaggtccggaaggaagcagcattaagtgaaacctctcatgtgccgcagggttgcctgggccgagctaactgtttaagtaacgcttggggtagcgaatcgacagaaggtgcacggtaaatcaatattaaatgtaactcatctagttaatctaggtgagttttttgttgctgtttaaagaatagttcagctgctttttttatacaaatagtcaaaaaatcttttttgagtctttttgttttttattaatcacaatgggaactagtgttcttattggcgtggcagatcaattcgaaaatctagaaaacaggtttttgattcacagaaagtagaaaatctatagttgaaatcatcattttcgtttattagaaaataaaggtgtgcttttgaattgatcggtgcatcatgtataataaaaaagatgataaatggaggagggcgtatttgtgagttatcaagctttgtatcgagtgttcagacctcaagtttttgaggatgttgttggacaagaacacatcacaaaaacgttgcaaaatgcccttttgcagaagaagttttctcatgcttacttattttcaggtcctagaggaacaggtaaaacaagtgctgctaaaatctttgcgaaggcagtgaactgtgaaaagtcacctgtgagtgaaccttgtaatgaatgtgatgcctgtaaagggattacaaacggctcgatttcagatgtgatcgaaatagatgctgcctcaaacaacggcgtagatgaaatccgtgatatacgtgataaagtgaagtttgcaccttcggcggttacatataaggtttatattatagatgaagtacatatgctctctatcggggcgtttaatgcccttcttaaaacgttagaggagccgcccgctcattgtatctttattttggctaccacagagcctcataagattcctcttaccatcatatctcgttgtcagagatttgattttaaacgaattacgacaaaagatattgttggaagaatgcagaaaattgtagatgcagaaagcctaaatgtacaagagggctcgctcgagattatcgctagtgcagctgatggtggtatgcgtgatgcactaagcctcttagatcaagccatttcatttagtggtgagcaactgacaattgatgatgcgctgctcattacaggagctgtttctcagcaattcattagtcagctagccgaagcaatttttgatcaaaatattgccgtggcgttagataccttaaatgaattacttcagcaggggaaagatgctgctaaattaattgaggacatgattttttattttagagatatgctgctttataaaacagcaccagatttggaaggagtccttgaaaaggtaaaggtcgatgaaaatttcgtgacgctttcggatcgtgtgacacctcaatttctatatgaaacaattgaagtgctgaataaaagtcaccaagaaatgaaatggacgaatcatccgaggattttctttgaggtagctgttgttaagctatgtcagtcaacggctggaataccgcaagctcatgctaacgctgatttaacgacactaacggataaaatagacaggttggaacaggagctatctaggataagagctgagggtgtgccaatgtctcattctcatcatcctcaagaaaaaaaggaagcacctcgaccacaaacgagtaacaaaaatggataccgtgcacctgtcggccgaattcacgagattctaaaagaagcaaaacgtccagagttagaaaaaattaaaggcaaatggggagaactccttgcccacttgaaacagcagaataaggtgtctcacgctgcactattaacggacagtgaaccagttgctgctgctactcatgcctttgttttaaaattcaagtttgaaatacattgtaaaatggttgctgaagataaaagtggtgttcgaaccaaccttgagcagctattagagtctatgttaggtaaaagagtggaattagttggcgttcctgacgctcaatggggtaaaataagagaagaatttttaagagatcatcagccggatgaacaggcagatggtcaggggacttctgctgaagaagatccgttgattgcagaagctaagaagttagtaggaaccgatttaattgaaattaaagattaataaaaatgaaagagagtggtgttcatatgcgcggtggaatgggaaatatgcaaaaaatgatgaaacaaatgcaaaaaatgcaaaaggatatggctaaggctcaagaagagcttgcagaaaaagtccttgaaggtaccgcaggtggcggtatggtcactgtaaaagtaaatggacaaaaagaagttgtcgatgtagcaatcaatgaagaagttgttgatccagaagatatcgatatgcttcaagatcttgtacttgcagcaacaaacgacgcattgaaaaaagtggatgagttaacaaatgaaacaatgggtcaattcacaaaaggaatgaacatgccaggtttattctaggaggaataactgaagatgcaatatcctgaaccaatatcaaagctgattgacagctttatgaaattgccaggaatcggaccaaaaactgcggtccgtctggctttttttgttcttagtatgcaggaagatgtcgtactagatttcgcgaaggcgcttgttaacgcaaagcgtaatttaacttattgctcggtatgcggccatatcacagatcaagatccttgctatatttgtgaagatacaagaagagatcaatctgttatctgtgtagtgcaagatccaaaagatgtgatcgcaatggaaaagatgaaagaatacaacggcttatatcatgtgcttcatggtgccatttcgccgatggatggcattggcccagaggatattaaaattcctgacctgttaaaaagattgcaagacgatcaagtgacagaggtaatacttgcaaccaatccaaacattgaaggagaggctacagccatgtatatctctagattgttgaaaccatcaggaattaaactctctcgtattgctcacggactaccagtaggtggagatttagagtatgcggatgaagtcacactgtctaaagctctagagggcagacgtgagatgtaggaaggagaagtacggtacatgggttttcttcgcagaaaatcaattcgaaaagaattcgatgagaaattaattcaacagctttttaagcaaaaggaagaatggaacagacaaaaaaagcttgtcgcaaatagcgttgagccttcaccggacattctattcgaattaaagcttgctcaagcgaagtactttttctatctaagagaagcgaaaaagaggaatttacgtttaaacaactggagatagcaggtctattttatatagtcctctcatatgcttgtactattcttatgaagaggagatgagaggattatggaacctgttattgtgatcggatcaattttgctagctgtgctattgttgtttatgtcaggtgttcaagcgaaccccttcaaatggttagggctgatcggagttaagtttgtggcaggtgctctttttttattttgcctcaatctatttggtgagagtctaggattacatgtttctattaaccctgtaacaagtggaatcagtggtttattgggcatcccaggcgtagcagctttagtcgtaattgaaaaatttattatttaatgaaaaatattgttgactttgatcctgtatggtgataaattaatatacgtcgctgatgacgaagaaacgaaaaaacatgataacaaaaaagttgttgacattaacaatttaaatatggtatgatgttctagtcgcttctgaagcggtaacgtgacaacggtcaaagatgccagcgatcaagacgcgcttgccgcatatgtcatcacagatgaagaaacgactgacctaaaggaaagtctaaaacgcacgttgccagactatatggtgccttcatggattatcaagttagaccaactgccgatgacggcaaatggcaaagtcgatctaaaagcattgccagcacctgataaggaagccaatcaaacagcttacgaatccccaagagacgaagttgaaacgcttctatgtggcatttgggaagacgtgcttggcgtcagccaagtcggcattcacgatcacttcttcttccttggaggagattcaattaaaggcatccaaatggcaagcagactcacacaagcaggctggaagctcgatatgaaactgcttttccaatacccaacgattgcggagctgcgcccatatatcgaagaagcggaccaactgacagccgaccaatcacctgtcgaaggggaagtcattttcacaccgattcagcgctggttctttgaacggaactttacgaatcagcaccattggaaccaatcggttatgctccaagcgccaaatggcttggatgaaaccatcgttcagcaagtgttggagcagctcatgatccatcacgatgcgctgcgaatggtgtatccgtttgaagaaggacgcgtgatccagcgtcatcgaaaaatcgaagaaaacttggtaactattgatgtaatggaagtacgaggggaactgtcgcagcaaatccagcaggtagaaaagctggcaaatgaagtgcaagcgagtatatcgctagcggaaggacctttagtaaagccagccattttccgaacggatcaaggggatcatttactgctcgctgtacatcatcttgtcatcgatggtgtgtcatggcgtattttccttgaagattttatggctctttatgaacagtcgaagcgcggggaaatcctgacacttcctgaaaaaacacactctttccaagaatatgcccagaagctgacggaatacgcgatgtcagatgagttgctgtcggaaagagcttattggaaaaaggtgcttgcgcatcccgttacaccaattcaaaaggatcatgtgacagaggatcagaggatgcttcatacacagaccattcgttttacattgtctgaggaggaaacacgcagtctgctgacagatgtacatgaagcatatcaaacagacatcaatgatattttgctgacagcactcggattgtctatgaaagagtggacaggagaagacagacactttattcatcttgaaggacacggaagagagaacatcctccctgcggtcaatgtatcacggacgattggctggtttacaagtatgtatcctgtgttactggatatgtcgcatacagacgatctttcttatcagattaagcatttgaaagaggagctcaggcacattccgaacaagggaatcggctacggcatattaaaatatttaacccctgacaagatgaaggaagatatctcattcgatctcgcgccagatatcagcttcaactatcttggtcagtttgatgaacagatcagcggtgagttaagccgctcaacgtggcatccaggacaatcgctgagtcctgaatcagagaaacctcatgcacttgatattgttggtttcgtcgaacaagctatgctccatgtgacaatttcttatcatcatcttgaatttgaagaacgtacgatggaacaattcaaggaccttcttgaaaagaatgtgaaggcgctgatctcacattgtgtatcacaggaagaaacccagatgacccctagtgatgtaggggatgaagatctcacgatggacgaacttgaaaagctaatggatatattttaagcaaacgaagaggtggacatatgagcaagcagaagattcaaaaggtatatcctttaacacccatgcaggagggcatgctgtatcatgccatgctagaccctaattcctcctcttatttcacacagcttgagcttggaataagcggagagtttgatcacgctctttttgaaaaaagtctcaatgagctcatacggacatatgacattctccgtacagcctttgtttatcaacaattacaaaagcctcgtcaggttgtacttgctgaacgtcatctcgatgtgtatagagaggatctatcacatctgaatcatcaagagcagcaaatggtattggatcaatataaaaaacaagtgagaaagcaaggatttcacttaacaaatgatctgttattgaaggtcgctgtttttcaactcaatgaaacaaactggcatctgatttggagcaaccatcacatcatcatggatggctggtccatgggtgttttaatgaaaaaattgtttcattactatgaatcttttcggaacggtcgaacgccggatcgctcacaagggaagccttatgcagattatatccagtggcttggaaagcaaaataaacaagaagcggaaagctattggctaaagcgtctagatggagcggttcagcatcaagggctgctacagcaaaaagaagcgaatgggcaatacgatcatcaggaatggacgtttacatgggatgctcaaacggtacaagccattcaaaatgtagcaagacaatgccaagtgacagccccgaacctgtttcaggctgtctggtctgttcttttagccacctatcatgcaactgatgatgtcacattcggcaccgttgtatcgggcagacctccaagtgtatctggaattgagcgcatggcagggctgtttatcaatacgatacccgttcgagtgacattggatcagaagcagacgtttaaacagttgtttcaaacggttcagcagcatgcactagaagcggaaaactatgattttatgccgctttatgacattcagcagaagacaactgctggagggcagctctttgatcatttggttgggtttgagaactatcctttagatcaggagctgtctggtgacaccatgtctgcacgtcttggtttttccattgatgtaaaggacggatttgaacaaacgaattttgatctaaatgtccttgtgtatccaggtgaaacgtggacattgaaaatcaaatacaacgccatagcttttgaagaaaaggtcattgaaaacatatcaaaacatctgaccaatctcatgaagcaaatcaccaaaaaccctgatgtacgccttcatgacgtgacatgtatcacggaagaagagaagcgacagataaaagcgtggaatcagacggagcgagattatccgaagcatctgtctattcctgagctgctcaatgaacgtatgaaggcgcagcctgaccatctagcactagttgaaggcgaccgaacatttacgtacgaggagcttggacaagaaatccgtcgtttagctggcagtcttattgaaaaaggcgtacagcccggggatgctgtggcggtgtatatgaaccgatcagctgatgcggtaatcgccatcttagcagttctccacgtaggggcagcttatgtaccgattgacccttcccagcctgaggagagaatccgatggatgcttgaagatagcggcgcatccattttgcttcatgctgatagtccgccgtcagttgatgaacagatcagggctgtacatgtgacgagtaagcctcatcactcacacatggatgtatcaatcaggacgtctccatctcacttggcgtatatcatgtatacatcggggtcaactggacagccaaaaggagttcaaattgagcatcagcatattgtgagattggcttgctctcaggagaaattaggcttgaccaagtcggatcgtatggcacatacaggtgccgtcagctttgacgccattacctttgaaatctttaccacgctgctgggtggcgcgacactgtatcctgttgaccgcgatactttattggatattcatcgattcgaacgatttatccaaacacatcagatcacgacgctctttttaacgactggattatttaatcagctcgctcagcagcgaccgcaaatattcaaaggattaaccacattaattacaggcggtgacgtgattaatgtgaagagtgcggagctcgtgaaacagcatcatccagcacttgttttactgaatgcctatggcccaacagaaaatacaaccatctcgaccatttacgaagtaagaggagatgaaacgggtccgattccaattggtcagccgatcaatcattcgtcggcttatattttagatgatgatcaaagattgcagccaattggagcgccaggagagctgtatgttggcggagatggtgtcgcaagagggtatctccatcgtccagatttgaccaatcaagtattcttggcagatccttttaagccgtcaggccgtttgtatcgaacaggggatttggctcggtatggcgcagatggccagatcgaattcctcggacgtacagatgatcaagtgaaaattcgaggcttccgtattgagcttggtgaaattgaaacagtgcttcagcaaaaagcgggcatagatgatgcggttgtgcttgtccattcgttttccacagatgaaaaggaaatcacggcttactttacagggacaatgacagaagaagaagtgcgagatgtatttaatcaagagctgccagcttatatggtgccgcaccatgtgatgaaactgaatgcttttccgctcacatcgaacggcaaggtagatcgaaaagctttaccaaagccggacgaagcctatcaggagaaaaaggaaatcattccgcctgagacggagacagaaaaggcactcgctcaaatttgggaggagcttcttggaaaaacggtaggagcagatgaacatttcttcatggctggcgggcactctctcaaagcgatgatgatgtccgcgaagattcaagaggtgcttcagaaagaagtgccgattcaagtgatttttgagaagccgacgattcgttcattagcggcatatatcgatcaggatggtcaagaagaaatggggcatccgattttaccagcagagcaggcggacgagtatccggtatcaccagctcagcgccgtttatatattttgcagacactcgaaccagacagcacgaattatcatattccaatcgtcttaacactagaagggacactcgaatatcagcggctcaaatcagcattcgatcagttgatccaaacgcacgaaatcctaagaacgagttttcatatgaatggagaagacattgttcaaagagtgaatgattggacggcatttgatcttcccgttcatgatgtcaaggaagaagaggcggaagcatttctttctgaacagcaatctccatttgatttaactgctgcgcctttattacgagcccagttgttgaaggtcagtgaaaaccgtcatcttcttgtcttggaagcacatcatctcattacagatggcagctccatgaaaacgtttatacaagatttggcgaaggcctatgatggagaagctcttgcagaaagagtcattcattataaagattacgctgtctggcagttaagtgaagaagagacggagaaacagaaggagcatgaagcctattggctgaagcaattcgaaggagaattgccagtattagagctgccaactgattattcgcgtccagcggagcgtgatttttcaggagaacgattcatgtttggctgtgatcaagtgacgactcagcggattcatgacctgcttcagaaaacagatacgaccatgtacatgttcttgttatctgcttttcaagtgctgcttgccacctatagcgggcaggaagatatcatcgttggttcccctgttgcaggacggacacatcctgatatacaggacatgccggggatgtttatcaacaccgttgcgatgcgcggaaaaccagagcaaacgaaaacatttttacagcttcttgaagaaataaaagaaacaagtgttgacgcttttgctcatcaaagctatccgctcgaagagttaattgcacgccttccgctagatcgtgatacaacccgaagtccgctctttagcgtgtcatttaacatgcagaacatggaggttcccgtactaaagctcggcgatctgcacatttcgccttatgccattcagcatcattcagtcaaatttgacttgtctctagaagcatttgaacgagagggagcattaaagctgagctttgactatgcagcggcgttatttaaagaagagacggtccgcagattcggaactcatcttctagcgattattcgtgaagcggtccaacacccggagaaacagatcggcttgctccgtatccttgatcagcatgagcaaatagagcggttggagaaaaaagacgaagtgcaaacaaatcgtcatgagcctttccatgtccaattttcacgtcaggcaaaggaaacaccagatgccattgcggtgatggatgatcaacggaagctcacttaccgcgagctagaagacatgtcaaatgcgcttggcagtgaactaaagatacgaggcgtcgagaaagaaaagactgtagcgctgattcttgaccgctctgtctatgtcatcgtttcaatgcttggtgtgatgaaagcgggtggtgcatttgtaccaattgatccggccttccctgcggaacgtatcaattacacattagaagattcaggtgcacaagtgatcgtaacaaatgagtctcttgcagaggcctatcaacatcacaagtcgattcaagttgtgcaggttgaaaaagcagtacttcaaagccgcacgctagatttgccggaagcatcagccgatcaacttgcgtatgtgatttacacatctgggacaacaggaaaaccgaagggtgttcagctcacgcatcgtaatctatcacactacgtgaactggctgacaaatgaggtgacattgcaagaatgcgatcggacggcactgctttcttcttatgcatacgatcttggttacacaagcattttccctgtcttaaaggcaggaggaacactgtatgtgcctcgtgaagatgtgtatacagacccggttcgactcatgcgtttaattgatgaacaagagctgacttatatcaaaatgacaccatccttatttcatatgatagcagattcgaaggatcatgcatttaacgctttacgccttgtcatacttggaggggaaccaattgtctctgaggatgtggaaacatttatggagcagcatccatgtgtggctgtcatgaaccactacggcccgacagagacaaccattggggctgtgaccaagctgattacaaagcaagagctaggcacactcaaggatcgctctgtgatcggacagccaattgctcacacaagagcgctcgcactcaatcgtcagcaacgcctcgttccatatggtgcacctggagagctttatatatcaggggaaggtgtatcgagagggtatttgaatcagcttgaattaacggcagagcgttttctagaaaatccgtattatcccgaagagcggatgtatcgtacaggagatttggtcagacagcatgcaaatggagacattgagtttctcggaagaatagatgatcaggtgaaaatacgcgggtatcgtattgaaaagcaagaaattgagtatgccgcacgtgcacgattatccattccagaggtgtatgtcaaagtactttatatgtcccgtttaccagagcttgcactttattacacatcgcctgaaccaattggaacactgacgtttagagaaaagcttgcggagacactgccggattatatgatcccaacgtactttgtcaaagtcgaccacatcccgcttactcaaaacggaaaggtagatgcgaagtctctgccgcttccgcacgaggtgcatatgaatcgcgcggtgcatgtagcaccagaaacggcacttgagcagacactttgcgatatttggtcagaagtacttggggttgaacaaataggtgttcatgatcacttctttgaattgggaggtcattccctcaaaggcatggtgctcatatcgaaaatgcaagccaagctgaacaaacatgtgccgctcaaagtcctttttgaaaagccaacgatacgggcgatggcagcttatttagaagaagtgaattcctcggacatgacatccattcaaccggcggagaagcaagatttctatcctgtctcttctgctcaaaagcggatgtatgtattgcagcagctgcatccagaagcagtgacttaccatatgcctgccgtattgatgatggaaggcagtcttgatgtaaaacagctagaagaagcgctgcaggctttgatcgaacgacatgaatcattgcgtacagcctttgtagaaattgacggcgtacccgttcaaaaagtctatcgccgagtgccgtttacgttagaggtggttgaagtagagaacggtcatgagcaacctgtcatagacgcattcatcaccccattctcattacatcaagcaccattaatgagggcaaaggtggcgaagctttctgatgagaaatatgtgttcatgatggatatgcaccatatcatcgcagatggtgtcacacgcagtctgctcattcaagaattggcaaagctgtatgagaaaaagacgttaccaccagttcagctgcactacaaggattatgcggtatggcagcaggaagaaaagcagcaagcgctgcttgagaaacagcgtcagtattggctggagcaatacgcagagcctcctgaagatttggcactgccacttgattttccgcgtcctcatgtacagtcatttgaaggagaccgagtcgatagatggttatctcctgagaaggtgcagaccattaaagcactcatggctgataaaggtgtgagcatgaacatggtcatgcaaacggcatttgccattttcctttccaaattaaccgggcagacagatatcgtcataggcgctgttacagcgggacgtacgcatgcttcaatcgaacgggttccaggcatgtttgtgaatacactggctcttcgacatgaagtacagctcgaggaaacgacagcacaattgcttgaaaaaatgaaagatcgaagcctatcagcctatgaacatcaagaatttccgtttgaggaattggtggcacagttagatcttccgaaagacacgagccgcaatccattgtttagtgtcatgctgacaacggatgaccgtgacatgacgttaccgaatctaaatggactcaagctttcgcaaaaacagcaagagacagctcatgcaaaatttgatgtaacgctcggtgtatttgaagaacaagatcaagtgggcgtacgctttgagtatgcaacggcgctgtttaaaaagaagaccattcagcgttggagtcgatattttgaacaaatcatagacgagatgctggtgaagctaaatgaaccaatttcatcgctttcgatcttaaatgaagaggaaaaacaagagctgatcaatgaatggtcgggtcctgtactaaatgtaccgtcagatcaaacggttcatgcactgattgaggctaaggcatacgagacgcctcatcaaaaagcggcaaccttctgcggaacgagctggacgtatgaagagctgaacagccgggcaaatacagtcgcttcaagactcatctcaaacggcataaaacgaggtgaccgcgtcggcattctgacccgtccgtcccttgacatgacggcagtcgtccttggcgtcttgaagtcaggtgcggcattcgttccaattgatgcggattatccggatcagcgtattgcctatatgctggaagactgcggggcagaggttcttctgatgcaaaaaggactggctgcaccaacttccttcacaggtcatgttctattgatagaagatgccgtagaaggcgaagcacacgatgttcaggttcatatgaaaccaacagatctcgcctatatgatttacacgtctggaacaacaggacagccgaagggtgtcatggttgagcaccagtcccttgtgaatctggcgttctggcacaatgatgctttccaagtgaccaatgcggatcgaaccgctaaatatgccggcaatgttctctcaaaactagataacaatgttcaaacttcacattagaataaaggttaagtcctcgatctattagtatctgtcagctccacgtgtcaccacgcttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttacattttaggaggcgaccgccccagtcaaactgcccacctgacactgtctccctgcccgataagggcagcgggttagaaggtcaatacagccagggtagtatcccaccgatgcctccaccgaagctagcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggcttctcggggctttaacaccctaagaagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactaaatttcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttgtccatcgcctacgcctttcggcctcggcttaggtcccgactaaccctgagcggacgagccttcctcaggaaaccttaggcattcggtggacgggattctcacccgtctttcgctactcataccggcattctcacttctaagcgctccaccagtccttccggtctgacttcacagcacttagaacgctctcctaccactgttcgtaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcatgcgccctattcagactcgctttcgctgcggctccgcatcttctgcttaaccttgcacgggatcgtaactcgccggttcattctacaaaaggcacgccatcaccctttaacgggctctgactacttgtaggcacacggtttcaggatctatttcactccccttccggggtgcttttcacctttccctcacggtactggttcactatcggtcactagggagtatttagccttgggagatggtcctcccggattccgacggaatttcacgtgttccgccgtactcaggatccactctggagagaacaacatttcagttacagggctgttaccttctttggcgggcctttccagacctcttcgcttatatcgttcctttgtaactccgtatagagtgtcctacaaccccaagaggcaagcctcttggtttgggctgttcccgtttcgctcgccgctactcagggaatcgcatttgctttctcttcctccgggtacttagatgtttcagttccccgggtatgccttctcatactctatgtattcaagtatggatactactccattacgagcagtgggtttccccattcggaaatctccggatcaaagcttgcttacagctccccgaagcatatcggtgttcgtcccgtccttcatcggctcctagtgccaaggcatccaccgtgcgccctttctaacttaaccatttcttactttagaaagaatcactatgtgtgatgaactttgcattgcattcaatgtgaatgtattacttattgttatctagttttcaaagaacaaggtcctactggcgctactggtgtaactggagatactggtcctactggggctactggcgcaactggtgatacaggtcctactggtgctactggtgtaactggcgatactggtccaacgggacctactggtgatactggcgcaactggtgatacaggtcctactggagttactggtgtaactggtgataccggtcctactggtgatactggtgtaaccggagataccggtcctactggagttactggtgcaactggagataccggacctactggagccactggtgcaactggagataccggacctactggtgatacaggtgctactggagttactggtgtaactggagataccggagctactggcacaactggagataccggtcctactggtgccactggtgtaactggagataccggacctactggagccactggtgtaactggtgatacaggtccaacgggacctactggagccactggtgcaaccggtgatacaggtcctactggggctactggcgcaactggagataccggatctactggagccactggtgtaactggtgatacaggtccaacgggacctactggagttactggtgtaaccggagatacaggtcctactggtgctactggtgatacgggacctactggagccactggtgtaactggagatactggtccaacgggacctactggtgtaactggagataccggtcctactggagccactggcgcaactggagatactggtcctactggtgccactggtgcaactggtgatacgggacctactggtgcaactggtgcaactggtgatacgggacctactggtgcaactggtgtaactggagataccggacctactggtgctactggtgccactggagataccggtccaacgggacctactggtgctactggtgatacaggtgctactggtgtaactggcgcaactggagatacaggtcctactggagttactggtgtaaccggagatacaggtcctactggtgcaactggcgcaactggggcaactggagatacaggtcctactggagttactggtgcaactggagataccggacctactggagctactggtgccactggagataccggacctactggcgctactggtgtaactggagatacaggtcctactggagttactggtgtaaccggagataccggtcctactggtgtaactggtgatacaggtccaacgggacctactggtgcaactggtgccactggagataccggtccaacgggacctactggtgcaactggtgatacaggtgctactggtgtaactggcgcaactggagatacaggtcctactggagttactggtgcaactggtgatgccggtcctactggagttactggtgtaactggagataccggacctactggagctactggcgcaactggagataccggacctactggtgctactggtgtaactggcgcaactggagatacgggacctactggagttactggtgcaactggagataccggacctactggagctactggtgtaactggagataccggacctactggaggcactggtgcaactggtgagtttgatcctggctcaggacgaacgctggcggcgtgcctaatacatgcaagtcgagcgaacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttctaaggatatatggagcagctccagttacaccagtggcaccagtaggtccggtatcaccagttgcgccagtagctccggtatctccagttacaccagtaactccagtagcacctgtatcaccagtagcaccagtaggtccggtatctccagttgcaccagtatcaccagtagctccggtatctccagttacaccagtaactccagtaggtccggtatctccagttgcaccagtggctccagtaggtcccgttggaccagtatcgccagttacaccagtggctccagtaggtccggtatctccagttgcaccagtggctccagtaggtccggtatctccagttgcaccagtaactccagtaggaccggtatctccggttacaccagtaggaccggtatctccagttacaccagtaggaccggtatctccagttacaccagttgcaccagtaggtccggtatcaccagttgcgccagtatcaccagtaggtcccgttggaccagtatcgccagttacaccagtagcaccagtaggaccggtatctccagttgcgccagtagccccagtaggaccagtatctccagttacaccagtagcgccagtaggacctgtatctccggttacaccagtaactccagtaggaccggtatcaccagtaggtccggtatctccagttgcaccagtgcctccagtaggtccggtatcaccagttgcgccagtagcaccagtaggtccggtatctccagttacaccagtagcaccagtaggtccggtatctccagttgcaccagtaactccagtaggaccggtatcaccagttgcgccagtggctccagtaggacctgtatcaccagttacaccagtggctccagtaggtcccgttggacctgtatcaccagttacaccagtggctccagtaggaccggtatgacttcactgggaaaggtgccgataacattaaaagtttctacaaagagctcgccggaaatgtagatatgttcatcagcttcatcgataagcaaaaagcctttcatgaaggtgtttctgggacactagatgatacaaactttggcggcgacacctttgtagaagaacactttttagataacgctgtacatatgggcatcaaaaacgccaaaagcattgtaaaggatcaaaaaaaggcacttaaaaccatttttcaagacatcgacgacctcatttctctagaagtatttgatagccaaaactttgatgaaaagattgcagatgcggaagacgagcgaaaaaagacagtgaaagacctaagagagcttgatcaaaatataaaagatgaatatgctttgtcagaaacggagcagcaagctacaatggcattgtacgcagaaatgatgaatgcgacaaatgacggaaaagccatttcacctatgaattttgacaagaaagcgtatcataatagcgaaatctacaaggcaaaaagcgatattgagaagcaaactgccgaatatctcaatattaaacaagaacaacaggaagcccgcgaaatcgcaaaggaacaagaagcactcgccaaccgtccttggtatgaaaaagcacttgattatggcgggaatattgtgaatgaactaactggcgtgaacgatgcaaaacgcgccgcaacgggcgttgacccgatcacaggcgaagaacttaccgcaggacagcgcgtcgccgcaggcggcatggcagcagcgggatatatccctatcgtcggctgggcagggcgcattttcaaaggcggaaaagccgtctataaaacgtggagcctagcgggatcgaaccgctgacctcctgcgtgcaaggcaggcgctctcccagctgagctaaggccccataaagatggtcgggaagacaggattcgaacctgcgaccccttggtcccaaaccaagtgctctaccaagctgagctacttcccgatcttaatggcgcgcccgagaggagtcgaacccctaaccttttgatccgtagtcaaacgctctatccaattgagctacgggcgcttattttataatgccgagggccggacttgaaccggcacggtagtcacctaccgcaggattttaagtcctgtgtgtctgccaattccaccaccccggcgtggatggtataagcggaagacgggattcgaacccgcgacccccaccttggcaaggtggtgttctaccactgaactacttccgcattacaggattactttattttatttggcaatgcgggtgaagggacttgaacccccacgtcataaagacactagatcctaagtctagcgcgtctgccaattccgccacacccgcatgaaacatggtgagccatgaaggactcgaaccttcgaccctctgattaaaagtcagatgctctaccaactgagctaatggctcgctttaaaagcgacttgtctattttaccatatgaaagtggtgccggcaagaggacttgaacccccaacctactgattacaagtcagttgctctaccagttgagctacaccggctttatctatcctaacattatgtaagaataaatatggtggaggatgacgggctcgaaccgccgaccctctgcttgtaaggcagatgctctcccagctgagctaatcctccatattttgttgtcatttcgaatgtctctcgatccgacaagtagtattatataacgataagatattgtttgtaaagacttttttaaaataatttttgaattaattttaacgctgtttttttcatcttttcgttaaggcacctaaagaagtttaccacttgtctcatcattttaaaagtctttttttcatttttttatgtttttttgttaaaaagcgctctaataacgcttcattgatgtaaaatgacccttttcatgttttttatatgcttgttttattcaatctatcttctcatacaaatcatctagagaagggattcttttattattttatttttctgagaaatcattttcatataaaaatatcagtaaatgatgctgttctttactatcttcaatattaaagtgttactggaggtaacaagttagttgttgattctttcttgttcttacttagaacgggcgtaaaaataaactgaaggtgctctatgctctttggcaatactcagttatctatagtgtatctctaacagtcctctttatctgttggctgccaaagaaaatcttattggctgctgtctatgcttttggtcttcatcctaaacgaattgaacgacctacccacacaacagctgcgttgttcaatgaaaatacataaaagtgaacggaagaaaaaattagctggtcgatgaggcttgctacatcatcacttctcactttacaaagcaatttaatagaagtaatttttactgcttctttgacttccgaaagtgcaagaagctgcgcttcaatttctgacagctcaatccggaagccgcgaatgttgacctgatggtcttttctgccgagatagatcagctcgccatcctctgtccatttcactaaatcgcctgtcaggtacatacgctcacccgaataaaatggatctgggacaaagcttttctctgtttcctctggaagattccagtaccctcttgccagtcctttccccgcaatcacgagctcacccggtacgcctggcggcgagaggtcatataacgaacccataatgtaaaaacgggtattggcaatcgctgttccaattggaagcgtgccttgatctgggttgatgatcccgcttgtcgccacgactgtgttttctgttggaccatagttattcacgagttgataaggaacaggctttacctgttttagcttgtctccgcctgttagtaagtaacgcaaggaatgattgtccatcgacataaactgctcgcatagctgggtcggcaggaatgcaatggtgatattttcgtcattgaaatacgcattgagcttgatcatatcgagacgaatcgcttcatcaatgatgtgcagctctgcgccggcgatccatgtcgggaacatttcccaaatggaggcatcaaagccaaaggcaactggagatacaggtcctactggagccactggtgcaggcttagcaggaattgtagcggctgatcctgtagtcagccctaattaccaagtagggcaagtagtgacctttaatggcagtacgtatgtagtaaatactacaccaccgtcaggtacaccagatacttccccagactacacattactagctgcagcaggactaactggaaccaccggtgcaaccgggcctactggatccacaggaaccaccggtgcaaccgggcctactggatccacaggaaccactggtgcaactggggctactggatccacagggatcactggtgcaaccgggcctactggatccacagggatcactggtgcaaccgggcctactggatccacagggatcactggtgcaactggggctactggatccacagggatcactggtgcaactgggcctactggatccacagggatcactggtgcaactggggctactggatccacaggaaccactggtgcaactgggcctactggatccacagggatcactggtgcaactggggctactggatccacagggatcactggtgctccagttacaccagtaactccagtagcacctgtatcaccagtagcaccagtaggaccggtatctccagttgcaccagtatcaccagtaggtccggtatctccagttgcaccagtggctccagtaggtcccgttggaccagtatcgccagttacaccagtggctccagtaggtccggtatctccagttgcaccagtgggtccagtaggtccggtatctccagttgcaccagtaactccagtaggaccggtatctccagttgcgccagtaggaccggtatcaccagttacaccagtaactccagtaggacctgtatcaccagttgcgccagtatcaccagtaggtcccgttggaccagtatctccagttacaccagtaggacctgtatcaccggttgcaccagtggctccagtaggtcccgttggacctgtatcaccagttacaccagttgcaccagtaggaccggtatctccggttacaccagtaactccagtaggacctgtatctccagttgccccagtagccccagtaggacctgtatctccagttgccccagtggctccagtaggacctgtatctttttaaatatctcttgatttattttcaatacatagtataatatcttttgtcactaaattgtctggtgatgatggcgaagaggtcacacccgttcccataccgaacacggaagttaagctcttcagcgccgatggtagttgggggtctccccctgtgagagtaggacatcgccaggctttcttcattccgcagtagctcagtggtagagctatcggctgttaaccgatcggtcgtaggttcgaatcctacctgcggagccaatttggagagctgtccgagtggccgaaggagcacgattggaaatcgtgtagacggtaaccccgtctcaagggttcgaatcccttgctctccgccacaaatttacataataaagggcccgttggtcaagcggttaagacaccgccctttcacggcggtaacacgggttcgaatcccgtacgggtcaccatttatagaatatacaccagtattttttattcggaggattagctcagctgggagagcatctgccttacaagcagagggtcggcggttcgagcccgtcatcctccaccatatcttaccagttacaccagttacaccagtaactccagtaggaccggtatcaccagttgcgccagtggcaccagtaggtccggtatcaccggttgcaccagtggcaccagtaggtcccgttggacctgtatcaccagttacaccagtggcaccagtaggaccggtatctccagttacaccagtggcaccagtaggtccggtatctccggttacaccagtaactccagtaggtcccgttggacctgtatcaccagttgcaccagtggcaccagtaggacctgtatcaccagtggcaccagttgatccttctgcagccagtaatgtgtagtctggggaagtatctggtgtacctgacggtggtgcagtatttactacatacgtactgccattaaaggtcactacttgccctacttggtaagtaggactgactaccggatcaaacgtttcaattcctgttaatcctgcaccagtagccccagtaggaccggtctatgtaggaatctctcgatccgacaaagattattatatacaggttttcatcatttgtaaaggctatattaaaaaaattttatttcaattttcattacgtatttcttttaacaaatgaccattatttcttctattaaaacagcgtgatctaacgttcatcacttaaacttctccactctatattctctttaaaaacgggcaattccttcataaatattcgcttctcacattagataccatgtggtccgtattagaattatctactattatcaatacagagcttttctatcatctattaatctaactctttactggttatttcatagttaactggaatacccgatctcatttttaaagtgtttcacatgcctgtaaatgcgctagagtgttgaaacgttcatcaaacaagtgcaatcagcagcatattttctcaagaagcttatatcatcgcggggtggagcagttcggtagctcgtcgggctcataacccgaaggtcgcaggttcaaatcctgcccccgcaaccaaattattttatacaccaatagggagtgctcattgagtgcaaccaaaatggtccggtagttcagttggttagaatgcctgcctgtcacgcaggaggtcgcgggttcgagtcccgtccggaccgccatttttaaaatgaatacatggctcggtagctcagttggtagagcaacggactgaaaatccgtgtgtcggcggttcgattccgtcccgagccacggttttaaaaaatatggcggaggaagagggattcgaacccccgcgggctttgacacccctgtcggttttcaagaccgatcccttcagccggacttgggtattcctccgtatggatggtggaccttgtaggactcgaacctacgaccggacggttatgagccgtctgctctaaccaactgagctaaaggtcctttatagcggcggaggggatcgaacccccgacctcacgggtatgaaccgtacgctctagccagctgagctacaccgccatgatcaaaataatcttttaaaaaggtccggtatctccagttacaccagtgcctccagtaggtccggtatctccagttacaccagtagctccagtaggtccggtatctccagttgcaccagtaactccagtaggaccggtatcaccagttgcgccagttacaccagtagcaccagtaggtccggtatctccagttgcgccagtagctccagtaggaccggcatcaccagttgcaccagtaactccagtaggacctgtatctccagttgcgccagttacaccagtagcacctgtatcaccagtatcaccagtcgttggtggagcctagcgggatcgaaccgctgacctcctgcgtgcaaggcaggcgctctcccagctgagctaaggccccgatttaatggaagatggtgggcctgagtggactcgaaccaccgacctcacgcttatcaggcgtgcgctctaaccagctgagctacaggcccatctttcatatcgaagatatgatgttgtaggatcttttgtaagttccttcaaaactaaacaagacgaaaacgcacatccgaggtatgcaggatgcatatcacacatgcgttgctacacgatgtagcgaacttagcatgtgatcatttcctgcctcgtcagcgtttgactgactacctatgatatttcataggatttttttataaaaactcgaattaacaggtacgttttgtcttgtttagttttcaaagatcatcttcggtatctccggttacaccagtaactccagtaggaccggtatctccagtaggtccggtatcaccagttgcaccagtgcctccagtaggtccggtatcaccagttgcgccagtagcaccagtaggtccggtatctccagttacaccagtagctccagtaggtccggtatcaggtcccgttggaccggtatctccagtggcaccagtggcaccagttgccccagtggctccagtaggacctgtatctccagttgccccagtggctccagtaggtcccgtatcaccagtactggaggcactggtgcaactggtgataccggacctactggagatacaggtcctactggagttactggtgtaaccggagataccggtcctactggtgccactggcgcaactggctctccatcaggtttggtggcgatagcgaagaggtcacacccgttcccataccgaacacggaagttaagctcttcagcgccgatggtagttgggggtctccccctgtgagagt
